(12) United States Patent
Yokoi et al.

(10) Patent No.: US 8,299,032 B2
(45) Date of Patent: Oct. 30, 2012

(54) SELF-ASSEMBLING PEPTIDE AND GEL PRODUCED FROM THE SAME

(75) Inventors: Hidenori Yokoi, Kasugai (JP); Takatoshi Kinoshita, Nagoya (JP)

(73) Assignee: Menicon Co., Ltd., Nagoya-Shi, Aichi (JP)

( * ) Notice: Subject to any disclaimer, the term of this patent is extended or adjusted under 35 U.S.C. 154(b) by 403 days.

(21) Appl. No.: 11/921,746

(22) PCT Filed: Jun. 26, 2006

(86) PCT No.: PCT/JP2006/312729
§ 371 (c)(1),
(2), (4) Date: Dec. 7, 2007

(87) PCT Pub. No.: WO2007/000979
PCT Pub. Date: Jan. 4, 2007

(65) Prior Publication Data
US 2010/0016548 A1 Jan. 21, 2010

(30) Foreign Application Priority Data
Jun. 27, 2005 (JP) ................................. 2005-186573

(51) Int. Cl.
*A61K 38/10* (2006.01)
*C07K 7/08* (2006.01)

(52) U.S. Cl. ....... 514/21.4; 514/21.5; 514/3.2; 530/325; 530/326; 530/327

(58) Field of Classification Search .................. None
See application file for complete search history.

(56) References Cited

U.S. PATENT DOCUMENTS

| | | | |
|---|---|---|---|
| 4,880,563 A * | 11/1989 | Dahms ........................... | 514/772 |
| 5,670,483 A | 9/1997 | Zhang et al. | |
| 5,955,343 A | 9/1999 | Holmes et al. | |
| 6,309,673 B1 * | 10/2001 | Duponchelle et al. ........ | 424/717 |
| 7,544,661 B2 * | 6/2009 | Stupp et al. ..................... | 514/12 |
| 2002/0160471 A1 | 10/2002 | Kisiday et al. | |
| 2003/0027247 A1* | 2/2003 | Wang et al. ................... | 435/69.1 |
| 2004/0235048 A1* | 11/2004 | Boden et al. .................... | 435/7.1 |
| 2004/0242469 A1 | 12/2004 | Lee et al. | |
| 2005/0181973 A1 | 8/2005 | Genove et al. | |
| 2005/0287186 A1 | 12/2005 | Ellis-Behnke et al. | |
| 2006/0084607 A1 | 4/2006 | Spirio et al. | |

FOREIGN PATENT DOCUMENTS

| | | |
|---|---|---|
| JP | 2005-515796 A | 6/2005 |
| WO | WO-02/062969 A2 | 8/2002 |
| WO | WO-03/096972 A2 | 11/2003 |
| WO | WO-2004/007683 A2 | 1/2004 |
| WO | WO-2005/014615 A2 | 2/2005 |
| WO | WO-2006/014570 A2 | 2/2006 |

OTHER PUBLICATIONS

Borza et al. (1998) Histidine-proline-rich glycoprotein as a plasma pH sensor. Modulation of its interaction with glycosaminoglycans by ph and metals, J. Biol. Chem., vol. 273, No. 10, pp. 5493-5499.*
Zhnag s. (2002) Emerging biological materials through molecular self-assembly, Biotechnol. Adv., vol. 20, issue 5-6, pp. 321-339.*
BOC334-Proteomics (2009, updated) www.ufs.ac.za/faculties/documents/04/112/B0C334/Practical%201.pdf, pp. 1-13.*
Altman et al. (2000) Conformational behavior of ionic self-complementary peptides, Protein Sci., vol. 9, No. 6, pp. 1095-1105.*
Aggeli et al. (2003) pH as a trigger of peptide beta-sheet self-assembly and reversible switching between nematic and isotropic phases, J. Am. Chem. Soc., vol. 125, No. 32, pp. 9619-9628.*
Genove et al. (2005) The effect of functionalized self-assembling peptide scaffolds on human aortic endothelial cell function, Biomaterials, vol. 26, pp. 3341-3351.*
Garreta et al. (2006) Osteogenic Differentiation of Mouse Embryonic Stem Cells and Mouse Embryonic Fibroblasts in a Three-Dimensional Self-Assembling Peptide Scaffold, Tisue Eng., vol. 12, No. 8, pp. 2215-2227.*
Makoto Hattori et al., Polymer Proteins, Japan, 2004, vol. 53, No. 2, p. 3Pd026.
Allman et al., Protein Science 2000, vol. 9, pp. 1095-1105.
Makoto Hattori et al., Polymer Proteins, Japan, 2004, vol. 53 ,No. 2, p. 3Pd026.
Zhang et al., Shuguang, "Designer self-assembling peptide nanofiber scaffolds for 3D tissue cell cultures," Seminars in Cancer Biology, vol. 15, (2005), pp. 413-420.

* cited by examiner

*Primary Examiner* — Anand Desai
*Assistant Examiner* — Samuel Liu
(74) *Attorney, Agent, or Firm* — Birch, Stewart, Kolasch & Birch, LLP (57) ABSTRACT

A self-assembling peptide containing a polar amino acid residue and a nonpolar amino acid residue, wherein the self-assembling peptide contains an acidic amino acid residue and a basic amino acid residue as the polar amino acid residues, a total sum of charge of the acidic amino acid residue and charge of the basic amino acid residue in a neutral region is the number excluding 0, and the self-assembling peptide is capable of forming a beta (β)-sheet structure in which only the nonpolar amino acid residue is arranged on one face upon self-assembly in an aqueous solution.

8 Claims, 2 Drawing Sheets

FIG. 1 Circular Dichroism Spectrum Measurement

FIG. 2 Atomic Force Microscopic Images of Nanofiber Comprising Self-Assembling Peptide (A) Peptide No. 1

(B) Peptide No. 2

(C) Peptide No. 3

(D) Peptide No. 4

(E) Peptide No. 5

(F) Peptide No. 6

(G) Peptide No. 7

(H) Peptide No. 8

(I) Peptide No. 9

SELF-ASSEMBLING PEPTIDE AND GEL PRODUCED FROM THE SAME

This application is the National Phase under 35 U.S.C. §371 of International Application PCT JP/2006/312729 filed on Jun. 26, 2006, from which priority is claimed, which in turn claims priority to Japanese Application 2005-186573, filed on Jun. 27, 2005.

TECHNICAL FIELD

The present invention relates to a self-assembling peptide and a gel comprising self-assembly of the peptide.

BACKGROUND ART

In general, when cells capable of proliferating three-dimensionally in vivo are cultured three-dimensionally, as a scaffold for the cells, for example, a collagen gel has been known. However, the collagen gel has a disadvantage that its application is limited by an animal or the like serving as a supplying source for the material.

Also, as a scaffold for the cells, a gel comprising peptides has been known (see, for example, Patent Publication 1 and Patent Publication 2). However, the gels disclosed in the Patent Publications 1 and 2 have a disadvantage that complicated procedures are required upon use.

Patent Publication 1: U.S. Pat. No. 5,670,483
Patent Publication 2: U.S. Pat. No. 5,955,343

DISCLOSURE OF THE INVENTION

Problems to be Solved by the Invention

The present invention relates to the provision of a self-assembling peptide capable of accomplishing at least any one of forming a stable gel in a neutral region, exhibiting excellent gel formability in a neutral region, forming a gel exhibiting excellent transparency in a neutral region, being capable of preparing the gel in simple procedures, and the like. Also, the present invention is to provide a gel capable of accomplishing at least any one of exhibiting excellent stability in a neutral region, exhibiting excellent transparency in a neutral region, carrying out a three-dimensional culture under conditions appropriate for the cells to be cultured, rapidly performing procedures, maintaining cells under conditions substantially close to in vivo environments, and the like.

Means to Solve the Problems

Specifically, the present invention relates to:
[1] a self-assembling peptide containing a polar amino acid residue and a nonpolar amino acid residue,
wherein the self-assembling peptide contains an acidic amino acid residue and a basic amino acid residue as the polar amino acid residues,
a total sum of charge of the acidic amino acid residue and charge of the basic amino acid residue in a neutral region is the number excluding 0, and the self-assembling peptide is capable of forming a beta (β)-sheet structure in which only the nonpolar amino acid residue is arranged on one face upon self-assembly in an aqueous solution; and
[2] a gel comprising self-assembly of a self-assembling peptide as defined in the above [1].

Effects of the Invention

According to the self-assembling peptide of the present invention, excellent effects that a stable gel exhibiting excellent transparency can be formed in a neutral region, that excellent gel formability can be exhibited in a neutral region, and that the gel can be prepared in simple procedures are exhibited. Also, according to the gel of the present invention, excellent effects that excellent stability and transparency are exhibited in a neutral region, that a three-dimensional culture can be carried out under conditions appropriate for the cells to be cultured, that procedures can be rapidly performed, and that cells can be maintained under conditions substantially close to in vivo environments are exhibited.

BEST MODE FOR CARRYING OUT THE INVENTION

In one aspect, the present invention relates to a self-assembling peptide containing a polar amino acid residue and a nonpolar amino acid residue, wherein the self-assembling peptide contains an acidic amino acid residue and a basic amino acid residue as the polar amino acid residues, a total sum of charge of the acidic amino acid residue and charge of the basic amino acid residue in a neutral region is the number excluding 0, and the self-assembling peptide is capable of forming a beta (β)-sheet structure in which only the nonpolar amino acid residue is arranged on one face upon self-assembly in an aqueous solution.

The self-assembling peptide of the present invention is a peptide containing a polar amino acid residue and a nonpolar amino acid residue, and one of the great features of the peptide resides in that the self-assembling peptide contains an acidic amino acid residue and a basic amino acid residue as the polar amino acid residues, and a total sum of charge of the acidic amino acid residue and charge of the basic amino acid residue in a neutral region is the number excluding 0. Therefore, according to the self-assembling peptide of the present invention, electrostatic attraction and electrostatic repulsion can be generated in good balance in the neutral region. Therefore, according to the self-assembling peptide of the present invention, an excellent effect that a gel can be stably formed without substantially causing excessive association is exhibited. Further, according to the self-assembling peptide of the present invention, an excellent effect that white turbidity and/or precipitation is not substantially generated in the neutral region is exhibited.

In addition, another one of the great features of the self-assembling peptide of the present invention resides in that the self-assembling peptide contains polar amino acid residues, i.e. an acidic amino acid residue and a basic amino acid residue, so that a total sum of charge of the acidic amino acid residue and charge of the basic amino acid residue in a neutral region is the number excluding 0. Therefore, according to the self-assembling peptide of the present invention, an excellent effect that the gel exhibiting excellent transparency can be formed in a neutral region. Also, according to the self-assembling peptide of the present invention, an excellent effect that the gel can be prepared in simple procedures is exhibited.

Another one of the great features of the self-assembling peptide of the present invention resides in that the self-assembling peptide is capable of forming a beta (β)-sheet structure in which only the nonpolar amino acid is arranged on one face upon self-assembly in an aqueous solution. Therefore, according to the self-assembling peptide of the present invention, an excellent effect that fiber can be stably formed is exhibited. For this reason, according to the self-assembling peptide of the present invention, an excellent effect that a gel can be stably formed is exhibited. Also, according to the self-assembling peptide of the present invention, an excellent gel formability is exhibited. Because of this excellent gel formability, the self-assembling peptide of the present invention can be suitably utilized as a scaffold in, for example, a three-dimensional culture of cells.

In the present invention, the term "self-assembling peptide" refers to a peptide actively assembling via an interaction such as hydrogen bonding, electrostatic interaction, van der Waals force, or hydrophobic interaction in a solvent. Concretely, for example, "a peptide self-assembling in an aqueous solution to form nanofiber or gel" is referred to as "self-assembling peptide."

Here, the term "nanofiber" as used herein refers to a fibrous molecular assembly having a width of a nanometer scale. It is assumed that the nanofiber forms a three-dimensional network structure by electrostatic attraction and repulsion acting between the fibers, whereby the self-assembling peptide of the present invention can form a gel.

For example, as described in Examples set forth below, in a case where a width or height of fiber estimated from scanning range with an atomic force microscope based on an applied voltage to a piezoelectric element is on a nanoscale, the formation of the nanofiber can be confirmed.

In addition, the term "gel" as used herein refers to a viscoelastic substance having both viscous property and elastic property. Concretely, the gel refers to a substance satisfying the formula G'>G", in a case where the gel is subjected to dynamic viscoelasticity measurement to determine a storage elastic modulus G' and a loss elastic modulus G". Here, the storage elastic modulus G' shows the elastic property, and the loss elastic modulus G" shows the viscous property.

The dynamic viscoelasticity can be determined with a dynamic viscoelasticity measurement apparatus as described in Examples set forth below. Concretely, the dynamic viscoelasticity can be determined by placing a sample on an iron plate, compressing the sample with an iron cone, and monitoring a stress applied to a motor rotating the iron cone when the cone is rotated.

The self-assembling peptide of the present invention contains a polar amino acid residue and a nonpolar amino acid residue.

Concretely, the self-assembling peptide of the present invention at least contains an acidic amino acid residue, a basic amino acid residue, and a nonpolar amino acid residue. The self-assembling peptide of the present invention preferably further contains at least one neutral amino acid residue, from the viewpoint of obtaining hydrophobic interaction and/or electrostatic interaction appropriate for self-assembly.

Here, in the present specification, since the neutral amino acid residue has a hydroxyl group, an acid amide group, a thiol group or the like, the neutral amino acid residue is considered to be classified as a polar amino acid residue as one having polarity. On the other hand, glycine does not expose its polar group because an amino group and a carboxyl group contained in the glycine are used in the peptide bonding of the amino acids with one another; therefore, the glycine is considered to be classified as a nonpolar amino acid residue.

In the present invention, the amino acid residue may be any residues of naturally occurring amino acids or non-naturally occurring amino acids. The amino acid residue is not particularly limited, preferably includes amino acids listed in Table 1 given hereinbelow, from the viewpoint of easily forming a beta (β)-sheet structure.

TABLE 1

| | Single Character |
|---|---|
| Polar Amino Acid (3 Letter Code) | |
| Acidic Amino Acid | |
| Aspartic Acid (Asp) | D |
| Glutamic Acid (Glu) | E |
| Basic Amino Acid | |
| Arginine (Arg) | R |
| Lysine (Lys) | K |
| Histidine (His) | H |
| Ornithine | — |
| Neutral Amino Acid | |
| Tyrosine (Tyr) | Y |
| Serine (Ser) | S |
| Threonine (Thr) | T |
| Asparagine (Asn) | N |
| Glutamine (Gln) | Q |
| Cysteine (Cys) | C |
| Nonpolar Amino Acid (3 Letter Code) | |
| Alanine (Ala) | A |
| Valine (Val) | V |
| Leucine (Leu) | L |
| Isoleucine (Ile) | I |
| Methionine (Met) | M |
| Phenylalanine (Phe) | F |
| Tryptophan (Trp) | W |
| Glycine (Gly) | G |

Among them, as the neutral amino acid residue usable in the present invention, an amino acid residue having a high hydrophilicity is preferable, from the viewpoint of obtaining an appropriate hydrophobic interaction, or an amino acid residue that is likely to form a beta (β)-sheet is preferable. It is desired that the amino acid residue is preferably a serine residue, an asparagine residue, a tyrosine residue, a threonine residue, a glutamine residue or a cysteine residue, and more preferably a serine residue or an asparagine residue.

In addition, as the acidic amino acid residue usable in the present invention, it is desired that the amino acid residue is preferably a naturally occurring acidic amino acid, and more preferably an aspartic acid residue or a glutamic acid residue, from the viewpoint of a low cost and facilitation in synthesis.

As the basic amino acid residue usable in the present invention, it is desired that the amino acid residue is preferably an arginine residue, a lysine residue, an ornithine residue, or a histidine residue, and more preferably an arginine residue or a lysine residue, from the viewpoint of a high water solubility in the neutral region and facilitation in synthesis.

In addition, as the nonpolar amino acid residue usable in the present invention, it is desired that the amino acid residue is preferably an alanine residue, a valine residue, a leucine residue, an isoleucine residue, a methionine residue, a tryptophan residue, a glycine residue or a phenylalanine residue, and more preferably an alanine residue or a phenylalanine residue, from the viewpoint of a high water solubility and facilitation in synthesis.

The self-assembling peptide of the present invention can, for example, self-assemble via an interaction or the like, such as an electrostatic interaction, a hydrogen bonding, or a hydrophobic interaction, between the peptide molecules in an aqueous solution.

The self-assembling peptide of the present invention consists of preferably 8 or more amino acid residues, more preferably 10 or more amino acid residues, and even more preferably 12 or more amino acid residues, from the viewpoint of allowing a sufficient interaction to act between the peptide molecules for self-assembly. The self-assembling peptide consists of preferably 200 or less amino acid residues, more preferably 50 or less amino acid residues, and even more preferably 32 or less amino acid residues, from the viewpoint of facilitation in the beta (β)-sheet formation and simplification of synthesis.

The self-assembly peptide of the present invention is capable of forming a beta (β)-sheet structure in an aqueous solution. In the beta (β)-sheet structure, only the nonpolar amino acid residues are arranged on one face. Also, both the polar amino acid residues and the nonpolar amino acid residues may be arranged on the other face, or only the polar amino acid residues may be arranged thereon. The beta (β)-sheet structure formed by the self-assembling peptide of the present invention, as mentioned above, comprises one face comprising a hydrophobic face in which only the nonpolar amino acid residues are arranged; and the other face comprising a hydrophilic face in which the polar amino acid residues are arranged. Therefore, the beta (β)-sheet having both the hydrophobic face and the hydrophilic face is assembled together so as to cover the hydrophobic face in an aqueous solution, thereby forming a bilayer structure. In addition, as a result, a sheet in which the polar amino acid residues are arranged, for example, on both of the faces is formed, and it is assumed that this sheet is extended as the self-assembly of the molecule is further progressed, thereby making it possible to constitute a nanofiber. Here, the presence or absence of the formation of the beta (β)-sheet structure can be confirmed by a circular dichroism measurement method as described in Examples set forth below.

The charge of the self-assembling peptide of the present invention in a neutral region, in other words, a total sum of charges of amino acid residues contained in the peptide is the number excluding zero (0). For this reason, the self-assembling peptide of the present invention exhibits an excellent characteristic that the positive charge and the negative charge derived from the amino acid residues do not substantially counterbalance each other even under conditions where all of the side chains of the polar amino acid residues contained in the self-assembling peptide are ionized in a neutral region. Therefore, in the self-assembling peptide of the present invention, for example, electrostatic attraction as well as electrostatic repulsion is allowed to act between the peptides, and a delicate balance is maintained therebetween; therefore, an excessive association is not substantially caused, whereby it is assumed that a stable gel can be formed without allowing the self-assembling peptide to precipitate in a neutral region.

The phrase "charge of the self-assembling peptide of the present invention in a neutral region" means a total sum of charges of amino acids contained in the self-assembling peptide in a neutral region. More concretely, the charge means a total sum of charges of charge of an acidic amino acid residue in a neutral region and charge of a basic amino acid residue in a neutral region.

It is desired that the charge of the peptide in the neutral region is preferably from −25 to −0.03, or that the charge is from +0.03 to +25, from the viewpoint of maintaining the balance between electrostatic attraction and repulsion appropriate for the gel formation. Also, it is desired that the number of the amino acid residues is up to 32 residues or so, from the viewpoint of facilitation in the production, in which case it is desired that the charge is preferably from −3 to −1, or from +1 to +3, and more preferably −3, −2, +2, or +3.

The charge of the self-assembling peptide of the present invention at each pH can be calculated in accordance with a method of, for example, Lehninger [*Biochimie*, 1979]. The method of Lehninger can be performed by running a program utilizable on, for example, a website for EMBL WWW Gateway to Isoelectric Point Service (www.embl-heidelberg.de/cgi/pi-wrapper.pl).

The term neutral region as used herein refers to a region of a pH of from 6 to 8, and preferably a pH of from 6.5 to 7.5. In addition, the aqueous solution may be any aqueous solution that is pH-controllable, and is not particularly limited. The aqueous solution includes, for example, an aqueous solution pH-controlled with sodium hydroxide or hydrochloric acid, various buffers such as a phosphate buffered saline (PBS) and Tris-HCl, a medium for cell culture such as D-MEM/F12 (1:1 (volume ratio)) medium (manufactured by Invitrogen), and the like.

The self-assembling peptide of the present invention can be prepared by a known method in the field. For example, the self-assembling peptide of the present invention may be synthesized by a chemical synthesis method such as a solid phase method such as an Fmoc method described in Examples set forth below, or a liquid phase method, or the self-assembling peptide may be generated by a molecular biological method such as genetically modified expression.

Examples of the self-assembling peptide of the present invention include, for example, peptides listed in Tables 2 to 7 (SEQ ID NOS: 13-444) given hereinbelow. In addition, the peptides of SEQ ID NOs: 1 to 9 of Sequence Listing are allowed to self-assemble in an aqueous solution to form a stable gel. Here, in Tables 2 to 7, X is an alanine residue, a valine residue, a leucine residue, an isoleucine residue, a methionine residue, a phenylalanine residue, a tryptophan residue, a glycine residue, a tyrosine residue, a serine residue, a threonine residue, an asparagine residue, a glutamine residue, or a cysteine residue. In addition, Z is an alanine residue, a valine residue, a leucine residue, an isoleucine residue, a methionine residue, a phenylalanine residue, a tryptophan residue, or a glycine residue.

TABLE 2

| RZXDZ-I | Sequence |
|---|---|
| 1-XZ | R Z X Z R Z X Z R Z D Z R Z D Z |
| 2-XZ | R Z X Z R Z D Z R Z X Z R Z D Z |
| 3-XZ | R Z X Z R Z D Z R Z D Z R Z X Z |
| 4-XZ | R Z D Z R Z X Z R Z X Z R Z D Z |
| 5-XZ | R Z D Z R Z X Z R Z D Z R Z X Z |
| 6-XZ | R Z D Z R Z D Z R Z X Z R Z X Z |
| 7-XZ | R Z X Z R Z X Z R Z X Z R Z D Z |
| 8-XZ | R Z X Z R Z X Z R Z D Z T Z X Z |
| 9-XZ | R Z X Z R Z D Z R Z X Z R Z X Z |
| 10-XZ | R Z D Z R Z X Z R Z X Z R Z X Z |
| 11-XZ | R Z X Z R Z X Z R Z D Z |
| 12-XZ | R Z X Z R Z D Z R Z X Z |
| 13-XZ | R Z D Z R Z X Z R Z X Z |
| 14-XZ | X Z D Z X Z D Z R Z D Z R Z D Z |
| 15-XZ | X Z D Z R Z D Z X Z D Z R Z D Z |
| 16-XZ | X Z D Z R Z D Z R Z D Z X Z D Z |
| 17-XZ | R Z D Z X Z D Z X Z D Z R Z D Z |
| 18-XZ | R Z D Z X Z D Z R Z D Z X Z D Z |

TABLE 2-continued

| | Sequence |
|---|---|
| 19-XZ | R Z D Z R Z D Z X Z D Z X Z D Z |
| 20-XZ | X Z D Z X Z D Z X Z D Z R Z D Z |
| 21-XZ | X Z D Z X Z D Z R Z D Z X Z D Z |
| 22-XZ | X Z D Z R Z D Z X Z D Z X Z D Z |
| 23-XZ | R Z D Z X Z D Z X Z D Z X Z D Z |
| 24-XZ | X Z D Z X Z D Z R Z D Z |
| 25-XZ | X Z D Z R Z D Z X Z D Z |
| 26-XZ | R Z D Z X Z D Z X Z D Z |
| RZXDZ-II | |
| 27-XZ | R Z R Z X Z X Z R Z R Z D Z D Z |
| 28-XZ | R Z R Z X Z D Z R Z R Z X Z D Z |
| 29-XZ | R Z R Z X Z D Z R Z R Z D Z X Z |
| 30-XZ | R Z R Z D Z X Z R Z R Z X Z D Z |
| 31-XZ | R Z R Z D Z X Z R Z R Z D Z X Z |
| 32-XZ | R Z R Z D Z D Z R Z R Z X Z X Z |
| 33-XZ | R Z R Z X Z X Z R Z R Z X Z D Z |
| 34-XZ | R Z R Z X Z X Z R Z R Z D Z X Z |
| 35-XZ | R Z R Z X Z D Z R Z R Z X Z X Z |
| 36-XZ | R Z R Z D Z X Z R Z R Z X Z X Z |
| 37-XZ | X Z X Z D Z D Z R Z R Z D Z D Z |
| 38-XZ | X Z R Z D Z D Z X Z R Z D Z D Z |
| 39-XZ | X Z R Z D Z D Z R Z X Z D Z D Z |
| 40-XZ | R Z X Z D Z D Z X Z R Z D Z D Z |
| 41-XZ | R Z X Z D Z D Z R Z X Z D Z D Z |
| 42-XZ | R Z R Z D Z D Z X Z X Z D Z D Z |
| 43-XZ | X Z X Z D Z D Z X Z R Z D Z D Z |
| 44-XZ | X Z X Z D Z D Z R Z X Z D Z D Z |
| 45-XZ | X Z R Z D Z D Z X Z X Z D Z D Z |
| 46-XZ | R Z X Z D Z D Z X Z X Z D Z D Z |
| RZXDZ-III | |
| 47-XZ | R Z R Z R Z X Z X Z X Z D Z |
| 48-XZ | R Z R Z R Z X Z D Z D Z X Z |
| 49-XZ | R Z R Z R Z D Z X Z X Z X Z |
| 50-XZ | X Z X Z R Z D Z D Z D Z D Z |
| 51-XZ | X Z R Z X Z D Z D Z D Z D Z |
| 52-XZ | R Z X Z X Z D Z D Z D Z D Z |
| RZXDZ-IV | |
| 53-XZ | R Z R Z R Z R Z X Z X Z D Z D Z |
| 54-XZ | R Z R Z R Z R Z X Z D Z X Z D Z |
| 55-XZ | R Z R Z R Z R Z X Z D Z D Z X Z |
| 56-XZ | R Z R Z R Z R Z D Z X Z X Z D Z |
| 57-XZ | R Z R Z R Z R Z D Z X Z D Z X Z |
| 58-XZ | R Z R Z R Z R Z D Z D Z X Z X Z |
| 59-XZ | R Z R Z R Z R Z X Z X Z X Z D Z |
| 60-XZ | R Z R Z R Z R Z X Z X Z D Z X Z |
| 61-XZ | R Z R Z R Z R Z X Z D Z X Z X Z |
| 62-XZ | R Z R Z R Z R Z D Z X Z X Z X Z |
| 63-XZ | X Z X Z R Z R Z R Z D Z D Z D Z |
| 64-XZ | X Z R Z X Z R Z R Z D Z D Z D Z |
| 65-XZ | X Z R Z R Z X Z R Z D Z D Z D Z |
| 66-XZ | X Z R Z R Z R Z X Z D Z D Z D Z |
| 67-XZ | R Z X Z X Z R Z R Z D Z D Z D Z |
| 68-XZ | R Z X Z R Z X Z R Z D Z D Z D Z |
| 69-XZ | X Z X Z X Z R Z R Z D Z D Z D Z |
| 70-XZ | X Z X Z R Z X Z R Z D Z D Z D Z |
| 71-XZ | X Z R Z X Z X Z R Z D Z D Z D Z |
| 72-XZ | R Z X Z X Z X Z R Z D Z D Z D Z |

TABLE 3

| | Sequence |
|---|---|
| RZXEZ-I | |
| 73-XZ | R Z X Z R Z X Z R Z E Z R Z E Z |
| 74-XZ | R Z X Z R Z E Z R Z X Z R Z E Z |
| 75-XZ | R Z X Z R Z E Z R Z E Z R Z X Z |
| 76-XZ | R Z E Z R Z X Z R Z X Z R Z E Z |
| 77-XZ | R Z E Z R Z X Z R Z E Z R Z X Z |
| 78-XZ | R Z E Z R Z E Z R Z X Z R Z X Z |
| 79-XZ | R Z X Z R Z X Z R Z X Z R Z E Z |
| 80-XZ | R Z X Z R Z X Z R Z E Z T Z X Z |
| 81-XZ | R Z X Z R Z E Z R Z X Z R Z X Z |
| 82-XZ | R Z E Z R Z X Z R Z X Z R Z X Z |
| 83-XZ | R Z X Z R Z X Z R Z E Z |
| 84-XZ | R Z X Z R Z E Z R Z X Z |
| 85-XZ | R Z E Z R Z X Z R Z X Z |
| 86-XZ | X Z E Z X Z E Z R Z E Z R Z E Z |
| 87-XZ | X Z E Z R Z E Z X Z E Z R Z E Z |
| 88-XZ | X Z E Z R Z E Z R Z E Z X Z E Z |
| 89-XZ | R Z E Z X Z E Z X Z E Z R Z E Z |
| 90-XZ | R Z E Z X Z E Z R Z E Z X Z E Z |
| 91-XZ | R Z E Z R Z E Z X Z E Z X Z E Z |
| 92-XZ | X Z E Z X Z E Z X Z E Z R Z E Z |
| 93-XZ | X Z E Z X Z E Z R Z E Z X Z E Z |
| 94-XZ | X Z E Z R Z E Z X Z E Z X Z E Z |
| 95-XZ | R Z E Z X Z E Z X Z E Z X Z E Z |
| 96-XZ | X Z E Z X Z E Z R Z E Z |
| 97-XZ | X Z E Z R Z E Z X Z E Z |
| 98-XZ | R Z E Z X Z E Z X Z E Z |
| RZXEZ-II | |
| 99-XZ | R Z R Z X Z X Z R Z R Z E Z E Z |
| 100-XZ | R Z R Z X Z E Z R Z R Z X Z E Z |
| 101-XZ | R Z R Z X Z E Z R Z R Z E Z X Z |
| 102-XZ | R Z R Z E Z X Z R Z R Z X Z E Z |
| 103-XZ | R Z R Z E Z X Z R Z R Z E Z X Z |
| 104-XZ | R Z R Z E Z E Z R Z R Z X Z X Z |
| 105-XZ | R Z R Z X Z X Z R Z R Z X Z E Z |
| 106-XZ | R Z R Z X Z X Z R Z R Z E Z X Z |
| 107-XZ | R Z R Z X Z E Z R Z R Z X Z X Z |
| 108-XZ | R Z R Z E Z X Z R Z R Z X Z X Z |
| 109-XZ | X Z X Z E Z E Z R Z R Z E Z E Z |
| 110-XZ | X Z R Z E Z E Z X Z R Z E Z E Z |
| 111-XZ | X Z R Z E Z E Z R Z X Z E Z E Z |
| 112-XZ | R Z X Z E Z E Z X Z R Z E Z E Z |
| 113-XZ | R Z X Z E Z E Z R Z X Z E Z E Z |
| 114-XZ | R Z R Z E Z E Z X Z X Z E Z E Z |
| 115-XZ | X Z X Z E Z E Z X Z R Z E Z E Z |
| 116-XZ | X Z X Z E Z E Z R Z X Z E Z E Z |
| 117-XZ | X Z R Z E Z E Z X Z X Z E Z E Z |
| 118-XZ | R Z X Z E Z E Z X Z X Z E Z E Z |
| RZXEZ-III | |
| 119-XZ | R Z R Z R Z X Z X Z X Z E Z |
| 120-XZ | R Z R Z R Z X Z E Z E Z X Z |
| 121-XZ | R Z R Z R Z E Z X Z X Z X Z |
| 122-XZ | X Z X Z R Z E Z E Z E Z E Z |
| 123-XZ | X Z R Z X Z E Z E Z E Z E Z |
| 124-XZ | R Z X Z X Z E Z E Z E Z E Z |
| RZXEZ-IV | |
| 125-XZ | R Z R Z R Z R Z X Z X Z E Z E A |
| 126-XZ | R Z R Z R Z R Z X Z E Z X Z E A |

TABLE 3-continued

| | Sequence |
|---|---|
| 127-XZ | R Z R Z R Z R Z X Z E Z E Z X Z |
| 128-XZ | R Z R Z R Z R Z E Z X Z X Z E Z |
| 129-XZ | R Z R Z R Z R Z E Z X Z E Z X Z |
| 130-XZ | R Z R Z R Z R Z E Z E Z X Z X Z |
| 131-XZ | R Z R Z R Z R Z X Z X Z X Z E Z |
| 132-XZ | R Z R Z R Z X Z X Z E Z X Z |
| 133-XZ | R Z R Z R Z X Z E Z X Z X Z |
| 134-XZ | R Z R Z R Z E Z X Z X Z X Z |
| 135-XZ | X Z X Z X Z R Z E Z E Z E Z E Z |
| 136-XZ | X Z X Z X Z R Z E Z E Z E Z E Z |
| 137-XZ | X Z R Z R Z X Z E Z E Z E Z E Z |
| 138-XZ | R Z X Z R Z R Z E Z E Z E Z E Z |
| 139-XZ | R Z X Z R Z X Z E Z E Z E Z E Z |
| 140-XZ | R Z R Z X Z X Z E Z E Z E Z E Z |
| 141-XZ | X Z X Z X Z R Z E Z E Z E Z E Z |
| 142-XZ | X Z X Z R Z X Z E Z E Z E Z E Z |
| 143-XZ | X Z R Z X Z X Z E Z E Z E Z E Z |
| 144-XZ | R Z X Z X Z X Z E Z E Z E Z E Z |

TABLE 4

| | Sequence |
|---|---|
| KZXDZ-I | |
| 145-XZ | K Z X Z K Z X Z K Z D Z K Z D Z |
| 146-XZ | K Z X Z K Z D Z K Z X Z K Z D Z |
| 147-XZ | K Z X Z K Z D Z K Z D Z K Z X Z |
| 148-XZ | K Z D Z K Z X Z K Z X Z K Z D Z |
| 149-XZ | K Z D Z K Z X Z K Z D Z K Z X Z |
| 150-XZ | K Z D Z K Z D Z K Z X Z K Z X Z |
| 151-XZ | K Z X Z K Z X Z K Z X Z K Z D Z |
| 152-XZ | K Z X Z K Z X Z K Z D Z K Z X Z |
| 153-XZ | K Z X Z K Z D Z K Z X Z K Z X Z |
| 154-XZ | K Z D Z K Z X Z K Z X Z K Z X Z |
| 155-XZ | K Z X Z K Z X Z K Z X Z K Z D Z |
| 156-XZ | K Z X Z K Z D Z K Z X Z K Z X Z |
| 157-XZ | K Z D Z K Z X Z K Z X Z K Z X Z |
| 158-XZ | X Z D Z X Z D Z K Z D Z K Z D Z |
| 159-XZ | X Z D Z K Z D Z X Z D Z K Z D Z |
| 160-XZ | X Z D Z K Z D Z K Z D Z X Z D Z |
| 161-XZ | K Z D Z X Z D Z X Z D Z K Z D Z |
| 162-XZ | K Z D Z X Z D Z K Z D Z X Z D Z |
| 163-XZ | K Z D Z K Z D Z X Z D Z X Z D Z |
| 164-XZ | X Z D Z X Z D Z X Z D Z K Z D Z |
| 165-XZ | X Z D Z X Z D Z K Z D Z X Z D Z |
| 166-XZ | X Z D Z K Z D Z X Z D Z X Z D Z |
| 167-XZ | K Z D Z X Z D Z X Z D Z X Z D Z |
| 168-XZ | X Z D Z X Z D Z K Z D Z |
| 169-XZ | X Z D Z K Z D Z X Z D Z |
| 170-XZ | K Z D Z X Z D Z X Z D Z |
| KZXDZ-II | |
| 171-XZ | K Z K Z X Z X Z K Z K Z D Z D Z |
| 172-XZ | K Z K Z X Z D Z K Z K Z X Z D Z |
| 173-XZ | K Z K Z K Z X Z K Z K Z D Z X Z |
| 174-XZ | K Z K Z D Z X Z K Z K Z D Z X Z |
| 175-XZ | K Z K Z D Z X Z K Z K Z D Z X Z |
| 176-XZ | K Z K Z D Z D Z K Z K Z X Z X Z |
| 177-XZ | K Z K Z X Z X Z K Z K Z D Z X Z |
| 178-XZ | K Z K Z X Z X Z K Z K Z D Z X Z |
| 179-XZ | K Z K Z X Z D Z K Z K Z X Z X Z |
| 180-XZ | K Z K Z D Z X Z K Z K Z X Z X Z |

TABLE 4-continued

| | Sequence |
|---|---|
| 181-XZ | X Z X Z D Z D Z K Z K Z D Z D Z |
| 182-XZ | X Z K Z D Z D Z X Z K Z D Z D Z |
| 183-XZ | X Z K Z D Z D Z K Z X Z D Z D Z |
| 184-XZ | K Z X Z D Z D Z X Z K Z D Z D Z |
| 185-XZ | K Z X Z D Z D Z K Z X Z D Z D Z |
| 186-XZ | K Z K Z D Z D Z X Z X Z D Z D Z |
| 187-XZ | X Z X Z D Z D Z X Z K Z D Z D Z |
| 188-XZ | X Z X Z D Z D Z K Z X Z D Z D Z |
| 189-XZ | X Z R Z D Z D Z X Z X Z D Z D Z |
| 190-XZ | K Z X Z D Z D Z X Z X Z D Z D Z |
| KZXDZ-III | |
| 191-XZ | K Z K Z K Z X Z X Z X Z D Z |
| 192-XZ | K Z K Z K Z X Z D Z X Z |
| 193-XZ | K Z K Z K Z D Z X Z X Z |
| 194-XZ | X Z X Z K Z D Z D Z D Z |
| 195-XZ | K Z K Z X Z D Z D Z D Z |
| 196-XZ | K Z X Z X Z D Z D Z D Z |
| KZXDZ-IV | |
| 197-XZ | K Z K Z K Z K Z X Z X Z D Z D Z |
| 198-XZ | K Z K Z K Z K Z X Z D Z X Z D Z |
| 199-XZ | K Z K Z K Z K Z X Z D Z D Z X Z |
| 200-XZ | K Z K Z K Z K Z D Z X Z X Z D Z |
| 201-XZ | K Z K Z K Z K Z D Z X Z D Z X Z |
| 202-XZ | K Z K Z K Z K Z D Z D Z X Z X Z |
| 203-XZ | K Z K Z K Z K Z X Z X Z X Z D Z |
| 204-XZ | K Z K Z K Z K Z X Z X Z D Z X Z |
| 205-XZ | K Z K Z K Z K Z X Z D Z X Z X Z |
| 206-XZ | K Z K Z K Z K Z D Z X Z X Z X Z |
| 207-XZ | X Z X Z K Z K Z D Z D Z D Z D Z |
| 208-XZ | X Z X Z K Z K Z D Z D Z D Z D Z |
| 209-XZ | X Z K Z X Z K Z D Z D Z D Z D Z |
| 210-XZ | K Z X Z X Z K Z D Z D Z D Z D Z |
| 211-XZ | K Z X Z K Z X Z D Z D Z D Z D Z |
| 212-XZ | K Z K Z X Z X Z D Z D Z D Z D Z |
| 213-XZ | X Z X Z X Z K Z D Z D Z D Z D Z |
| 214-XZ | X Z X Z K Z X Z D Z D Z D Z D Z |
| 215-XZ | X Z K Z X Z X Z D Z D Z D Z D Z |
| 216-XZ | K Z X Z X Z X Z D Z D Z D Z D Z |

TABLE 5

| | Sequence |
|---|---|
| KZXEZ-I | |
| 217-XZ | K Z X Z K Z X Z K Z E Z K Z E Z |
| 218-XZ | K Z X Z K Z E Z K Z X Z K Z E Z |
| 219-XZ | K Z X Z K Z E Z K Z E Z K Z X Z |
| 220-XZ | K Z E Z K Z X Z K Z X Z K Z E Z |
| 221-XZ | K Z E Z K Z X Z K Z E Z K Z X Z |
| 222-XZ | K Z E Z K Z E Z K Z X Z K Z X Z |
| 223-XZ | K Z X Z K Z X Z K Z X Z K Z E Z |
| 224-XZ | K Z X Z K Z X Z K Z E Z T Z X Z |
| 225-XZ | K Z X Z K Z E Z K Z X Z K Z X Z |
| 226-XZ | K Z E Z K Z X Z K Z X Z K Z X Z |
| 227-XZ | K Z X Z K Z X Z K Z E Z |
| 228-XZ | K Z X Z K Z E Z K Z X Z |
| 229-XZ | K Z E Z K Z X Z K Z X Z |
| 230-XZ | X Z E Z X Z E Z K Z E Z K Z E Z |
| 231-XZ | X Z E Z K Z E Z X Z E Z K Z E Z |
| 232-XZ | X Z E Z K Z E Z K Z E Z X Z E Z |
| 233-XZ | K Z E Z X Z E Z X Z E Z K Z E Z |
| 234-XZ | K Z E Z X Z E Z K Z E Z X Z E Z |

TABLE 5-continued

| | |
|---|---|
| 235-XZ | K Z E Z K Z E Z X Z E Z X Z E Z |
| 236-XZ | X Z E Z X Z E Z X Z E Z K Z E Z |
| 237-XZ | X Z E Z X Z E Z K Z E Z X Z E Z |
| 238-XZ | X Z E Z K Z E Z X Z E Z X Z E Z |
| 239-XZ | K Z E Z X Z E Z X Z E Z X Z E Z |
| 240-XZ | X Z E Z X Z E Z X Z E Z K Z E Z |
| 241-XZ | X Z E Z X Z E Z X Z E Z X Z E Z |
| 242-XZ | K Z E Z X Z E Z X Z E Z X Z E Z |
| KZXEZ-II | |
| 243-XZ | K Z K Z X Z X Z K Z K Z E Z E Z |
| 244-XZ | K Z K Z X Z E Z K Z K Z X Z E Z |
| 245-XZ | K Z K Z X Z E Z K Z K Z E Z X Z |
| 246-XZ | K Z K Z E Z X Z K Z K Z X Z E Z |
| 247-XZ | K Z K Z E Z E Z K Z K Z E Z X Z |
| 248-XZ | K Z K Z E Z E Z K Z K Z X Z X Z |
| 249-XZ | K Z K Z X Z X Z K Z K Z X Z E Z |
| 250-XZ | K Z K Z X Z X Z K Z K Z E Z X Z |
| 251-XZ | K Z K Z E Z X Z K Z K Z X Z X Z |
| 252-XZ | K Z K Z E Z X Z K Z K Z X Z X Z |
| 253-XZ | X Z X Z E Z E Z K Z K Z E Z E Z |
| 254-XZ | X Z K Z E Z E Z X Z K Z E Z E Z |
| 255-XZ | X Z K Z E Z E Z K Z X Z E Z E Z |
| 256-XZ | K Z X Z E Z E Z X Z K Z E Z E Z |
| 257-XZ | K Z X Z E Z E Z K Z X Z E Z E Z |
| 258-XZ | K Z K Z E Z E Z X Z X Z E Z E Z |
| 259-XZ | X Z X Z E Z E Z X Z K Z E Z E Z |
| 260-XZ | X Z X Z E Z E Z K Z X Z E Z E Z |
| 261-XZ | X Z R Z E Z E Z X Z X Z E Z E Z |
| 262-XZ | K Z X Z E Z E Z X Z X Z E Z E Z |
| KZXEZ-III | |
| 263-XZ | K Z K Z K Z X Z X Z X Z E Z |
| 264-XZ | K Z K Z K Z X Z X Z E Z X Z |
| 265-XZ | K Z K Z K Z X Z E Z X Z E Z |
| 266-XZ | X Z X Z K Z E Z E Z E Z |
| 267-XZ | X Z K Z X Z E Z E Z E Z |
| 268-XZ | K Z X Z X Z E Z E Z E Z |
| KZXEZ-IV | |
| 269-XZ | K Z K Z K Z K Z X Z X Z E Z E Z |
| 270-XZ | K Z K Z K Z K Z X Z E Z X Z E Z |
| 271-XZ | K Z K Z K Z K Z X Z E Z E Z X Z |
| 272-XZ | K Z K Z K Z K Z E Z X Z X Z E Z |
| 273-XZ | K Z K Z K Z K Z E Z X Z E Z X Z |
| 274-XZ | K Z K Z K Z K Z E Z E Z X Z X Z |
| 275-XZ | K Z E Z K Z E Z X Z X Z X Z E Z |
| 276-XZ | K Z K Z X Z K Z X Z E Z E Z X Z |
| 277-XZ | K Z K Z X Z K Z E Z X Z E Z X Z |
| 278-XZ | K Z K Z K Z E Z X Z X Z Z X Z |
| 279-XZ | X Z K Z K Z E Z X Z E Z E Z E Z |
| 280-XZ | X Z K Z K Z E Z E Z E Z E Z E Z |
| 281-XZ | X Z K Z K Z E Z E Z E Z E Z E Z |
| 282-XZ | K Z X Z X Z E Z E Z E Z E Z E Z |
| 283-XZ | X Z X Z K Z E Z E Z E Z E Z E Z |
| 284-XZ | X Z X Z X Z E Z E Z E Z E Z E Z |
| 285-XZ | X Z X Z X Z E Z E Z E Z E Z E Z |
| 286-XZ | X Z X Z X Z E Z E Z E Z E Z E Z |
| 287-XZ | X Z X Z X Z E Z E Z E Z E Z E Z |
| 288-XZ | K Z X Z X Z X Z E Z E Z E Z E Z |

TABLE 6

| | Sequence |
|---|---|
| HZXDZ-I | |
| 289-XZ | H Z X Z H Z X Z H Z D Z H Z D Z |
| 290-XZ | H Z X Z H Z D Z H Z X Z H Z D Z |
| 291-XZ | H Z X Z H Z D Z H Z D Z H Z X Z |
| 292-XZ | H Z D Z H Z X Z H Z X Z H Z D Z |
| 293-XZ | H Z D Z H Z X Z H Z D Z H Z X Z |
| 294-XZ | H Z D Z H Z D Z H Z X Z H Z X Z |
| 295-XZ | H Z X Z H Z X Z H Z X Z H Z D Z |
| 296-XZ | H Z X Z H Z X Z H Z D Z H Z X Z |
| 297-XZ | H Z X Z H Z D Z H Z X Z H Z X Z |
| 298-XZ | H Z D Z H Z X Z H Z X Z H Z X Z |
| 299-XZ | H Z X Z H Z X Z H Z D Z |
| 300-XZ | H Z X Z H Z D Z H Z X Z |
| 301-XZ | H Z D Z H Z X Z H Z X Z |
| 302-XZ | X Z D Z X Z D Z H Z D Z H Z D Z |
| 303-XZ | X Z D Z H Z D Z X Z D Z H Z D Z |
| 304-XZ | X Z D Z H Z D Z H Z D Z X Z D Z |
| 305-XZ | H Z D Z X Z D Z X Z D Z H Z D Z |
| 306-XZ | H Z D Z X Z D Z H Z D Z X Z D Z |
| 307-XZ | H Z D Z H Z D Z X Z D Z X Z D Z |
| 308-XZ | X Z D Z X Z D Z X Z D Z H Z D Z |
| 309-XZ | X Z D Z X Z D Z H Z D Z X Z D Z |
| 310-XZ | X Z D Z H Z D Z X Z D Z X Z D Z |
| 311-XZ | H Z D Z X Z D Z X Z D Z X Z D Z |
| 312-XZ | X Z D Z X Z D Z H Z D Z |
| 313-XZ | X Z D Z H Z D Z X Z D Z |
| 314-XZ | H Z D Z X Z D Z X Z D Z |
| HZXDZ-II | |
| 315-XZ | H Z H Z X Z X Z H Z H Z D Z D Z |
| 316-XZ | H Z H Z X Z D Z H Z H Z X Z D Z |
| 317-XZ | H Z H Z X Z D Z H Z H Z D Z X Z |
| 318-XZ | H Z H Z D Z X Z H Z H Z X Z D Z |
| 319-XZ | H Z H Z D Z X Z H Z H Z D Z X Z |
| 320-XZ | H Z H Z D Z D Z H Z H Z X Z X Z |
| 321-XZ | H Z H Z X Z X Z H Z H Z X Z D Z |
| 322-XZ | H Z H Z X Z X Z H Z H Z D Z X Z |
| 323-XZ | H Z H Z X Z D Z H Z H Z X Z X Z |
| 324-XZ | H Z H Z D Z X Z H Z H Z X Z X Z |
| 325-XZ | X Z X Z D Z D Z K Z K Z D Z D Z |
| 326-XZ | X Z K Z D Z D Z X Z K Z D Z D Z |
| 327-XZ | X Z K Z D Z D Z K Z X Z D Z D Z |
| 328-XZ | K Z X Z D Z D Z X Z K Z D Z D Z |
| 329-XZ | K Z X Z D Z D Z K Z X Z D Z D Z |
| 330-XZ | K Z K Z D Z D Z X Z X Z D Z D Z |
| 331-XZ | X Z X Z D Z D Z X Z K Z D Z D Z |
| 332-XZ | X Z X Z D Z D Z K Z X Z D Z D Z |
| 333-XZ | X Z R Z D Z D Z X Z X Z D Z D Z |
| 334-XZ | K Z X Z D Z D Z X Z X Z D Z D Z |
| HZXDZ-III | |
| 335-XZ | K Z K Z K Z X Z X Z X Z D Z |
| 336-XZ | K Z K Z K Z X Z X Z D Z X Z |
| 337-XZ | K Z K Z K Z X Z D Z X Z X Z |
| 338-XZ | X Z X Z K Z D Z D Z D Z |
| 339-XZ | X Z K Z X Z D Z D Z D Z |
| 340-XZ | K Z X Z X Z D Z D Z D Z |
| HZXDZ-IV | |
| 341-XZ | K Z K Z K Z K Z X Z X Z D Z D Z |
| 342-XZ | K Z K Z K Z K Z X Z D Z X Z D Z |

TABLE 6-continued

| | |
|---|---|
| 343-XZ | H Z H Z H Z H Z X Z D Z D Z X Z |
| 344-XZ | H Z H Z H Z H Z D Z X Z X Z D Z |
| 345-XZ | H Z H Z H Z H Z D Z X Z D Z X Z |
| 346-XZ | H Z H Z H Z H Z D Z D Z X Z X Z |
| 347-XZ | H Z H Z H Z H Z X Z X Z X Z D Z |
| 348-XZ | H Z H Z H Z H Z X Z X Z D Z X Z |
| 349-XZ | H Z H Z H Z H Z X Z D Z X Z X Z |
| 350-XZ | H Z H Z H Z H Z D Z X Z X Z X Z |
| 351-XZ | X Z X Z H Z H Z D Z D Z D Z D Z |
| 352-XZ | X Z H Z X Z H Z D Z D Z D Z D Z |
| 353-XZ | X Z H Z H Z X Z D Z D Z D Z D Z |
| 354-XZ | H Z X Z X Z H Z D Z D Z D Z D Z |
| 355-XZ | H Z X Z H Z X Z D Z D Z D Z D Z |
| 356-XZ | H Z H Z X Z X Z D Z D Z D Z D Z |
| 357-XZ | X Z X Z X Z H Z D Z D Z D Z D Z |
| 358-XZ | X Z X Z H Z X Z D Z D Z D Z D Z |
| 359-XZ | X Z H Z X Z X Z D Z D Z D Z D Z |
| 360-XZ | H Z X Z X Z X Z D Z D Z D Z D Z |

TABLE 7

| | Sequence |
|---|---|
| HZXEZ-I | |
| 361-XZ | H Z X Z H Z X Z H Z E Z H Z E Z |
| 362-XZ | H Z X Z H Z E Z H Z X Z H Z E Z |
| 363-XZ | H Z X Z H Z E Z H Z E Z H Z X Z |
| 364-XZ | H Z E Z H Z X Z H Z X Z H Z E Z |
| 365-XZ | H Z E Z H Z X Z H Z E Z H Z X Z |
| 366-XZ | H Z E Z H Z E Z H Z X Z H Z X Z |
| 367-XZ | H Z X Z H Z X Z H Z X Z H Z E Z |
| 368-XZ | H Z X Z H Z X Z H Z E Z H Z X Z |
| 369-XZ | H Z X Z H Z E Z H Z X Z H Z X Z |
| 370-XZ | H Z E Z H Z X Z H Z X Z H Z X Z |
| 371-XZ | [redacted] |
| 372-XZ | [redacted] |
| 373-XZ | [redacted] |
| 374-XZ | X Z E Z X Z E Z H Z E Z H Z E Z |
| 375-XZ | X Z E Z H Z E Z X Z E Z H Z E Z |
| 376-XZ | X Z E Z H Z E Z H Z E Z X Z E Z |
| 377-XZ | H Z E Z X Z E Z X Z E Z H Z E Z |
| 378-XZ | H Z E Z X Z E Z H Z E Z X Z E Z |
| 379-XZ | H Z E Z H Z E Z X Z E Z X Z E Z |
| 380-XZ | X Z E Z X Z E Z X Z E Z H Z E Z |
| 381-XZ | X Z E Z X Z E Z H Z E Z X Z E Z |
| 382-XZ | X Z E Z H Z E Z X Z E Z X Z E Z |
| 383-XZ | H Z E Z X Z E Z X Z E Z X Z E Z |
| 384-XZ | [redacted] |
| 385-XZ | [redacted] |
| 386-XZ | [redacted] |
| HZXEZ-II | |
| 387-XZ | H Z H Z X Z X Z H Z H Z E Z E Z |
| 388-XZ | H Z H Z X Z E Z H Z H Z X Z E Z |
| 389-XZ | H Z H Z X Z E Z H Z H Z E Z X Z |
| 390-XZ | H Z H Z E Z X Z H Z H Z E Z X Z |
| 391-XZ | H Z H Z E Z X Z H Z H Z E Z X Z |
| 392-XZ | H Z H Z E Z E Z H Z H Z X Z X Z |
| 393-XZ | H Z H Z X Z X Z H Z H Z E Z X Z |
| 394-XZ | H Z H Z X Z X Z H Z H Z E Z X Z |
| 395-XZ | H Z H Z X Z E Z H Z H Z X Z X Z |
| 396-XZ | H Z H Z E Z X Z H Z H Z X Z X Z |
| 397-XZ | X Z X Z E Z E Z K Z K Z E Z E Z |
| 398-XZ | X Z K Z E Z E Z X Z K Z E Z E Z |
| 399-XZ | X Z K Z E Z E Z K Z X Z E Z E Z |
| 400-XZ | K Z X Z E Z E Z X Z K Z E Z E Z |
| 401-XZ | K Z X Z E Z E Z K Z X Z E Z E Z |
| 402-XZ | K Z K Z E Z E Z X Z X Z E Z E Z |
| 403-XZ | X Z X Z E Z E Z X Z K Z E Z E Z |
| 404-XZ | X Z X Z E Z E Z K Z X Z E Z E Z |
| 405-XZ | X Z R Z E Z E Z X Z X Z E Z E Z |
| 406-XZ | K Z X Z E Z E Z X Z X Z E Z E Z |
| HZXEZ-III | |
| 407-XZ | [redacted] |
| 408-XZ | [redacted] |
| 409-XZ | [redacted] |
| 410-XZ | [redacted] |
| 411-XZ | [redacted] |
| 412-XZ | [redacted] |
| HZXEZ-IV | |
| 413-XZ | K Z K Z K Z K Z X Z X Z E Z E Z |
| 414-XZ | K Z K Z K Z K Z X Z E Z X Z E Z |
| 415-XZ | H Z H Z H Z H Z X Z E Z E Z X Z |
| 416-XZ | H Z H Z H Z H Z E Z X Z X Z E Z |
| 417-XZ | H Z H Z H Z H Z E Z X Z E Z X Z |
| 418-XZ | H Z H Z H Z H Z E Z E Z X Z X Z |
| 419-XZ | H Z H Z H Z H Z X Z X Z X Z E Z |
| 420-XZ | H Z H Z H Z H Z X Z X Z E Z X Z |
| 421-XZ | H Z H Z H Z H Z X Z E Z X Z X Z |
| 422-XZ | H Z H Z H Z H Z E Z X Z X Z X Z |
| 423-XZ | X Z X Z H Z H Z E Z E Z E Z E Z |
| 424-XZ | X Z H Z X Z H Z E Z E Z E Z E Z |
| 425-XZ | X Z H Z H Z X Z E Z E Z E Z E Z |
| 426-XZ | H Z X Z X Z H Z E Z E Z E Z E Z |
| 427-XZ | H Z X Z H Z X Z E Z E Z E Z E Z |
| 428-XZ | H Z H Z X Z X Z E Z E Z E Z E Z |
| 429-XZ | X Z X Z X Z H Z E Z E Z E Z E Z |
| 430-XZ | X Z X Z H Z X Z E Z E Z E Z E Z |
| 431-XZ | X Z H Z X Z X Z E Z E Z E Z E Z |
| 432-XZ | H Z X Z X Z X Z E Z E Z E Z E Z |

In another aspect, the present invention relates to a gel comprising self-assembly of the self-assembling peptide.

The gel of the present invention can be prepared by dissolving at least one kind of a self-assembling peptide of the present invention in the aqueous solution so as to have, for example, a final concentration of from 0.3 to 5.0% by weight, and preferably from 0.5 to 1.5% by weight, and allowing the solution to stand to for some time to self-assemble the peptide. The temperature or the time period upon allowing the solution to stand is not particularly limited, so long as the self-assembling peptide mentioned above is allowed to self-assemble, and the temperature or the time period may be properly adjusted depending upon the purposes of use of the gel, the kinds of the peptides, and the concentration in the aqueous solution.

In a case where the gel of the present invention is used, for example, as a scaffold for a three-dimensional culture of the cells, it is desired that the used concentration of the self-assembling peptide of the present invention upon gel formation in a medium for cell culture is preferably 0.3% by weight or more, and more preferably 0.5% by weight or more, from the viewpoint of easiness in gel formation, and that the used concentration of the peptide is preferably 5% by weight or less, and more preferably 2% by weight or less, from the viewpoint of easy miscibility with the cells. In addition, in such a case, it is preferable that the gel is transparent, from the viewpoint of easiness in cell observation with a fluorescent microscope or the like. For example, in a gel containing 0.5% by weight of a self-assembling peptide, it is desired that the visible light transmittance which is determined in terms of absorbance at 380 to 780 nm in a cell having an optical path of 10 mm is at least 50%/cm, and it is desired that the visible light transmittance is preferably 70%/cm or more, and more preferably 90% 1 cm or more. Further, it is desired that the visible light transmittance of the gel after allowing it to stand at room temperature for a long period of time, for example, 2 months, is preferably 50%/cm or more, more preferably 70%/cm or more, and even more preferably 90%/cm or more, from the viewpoint of long-term stability of the gel, and that the decreasing ratio (%) of the visible light transmittance (100−(visible light transmittance after storage/visible light transmittance before storage×100)) is preferably 30% or less, more preferably 20% or less, and even more preferably 10% or less. The transparency of the gel can be determined with UV/VIS measurement apparatus as described in Examples set forth below.

In the present invention, a transparent gel refers to, for example, a gel having a visible light transmittance of 50%/cm or more in a case where the transmittance is determined in terms of absorbance at 380 to 780 nm in a cell having an optical path of 10 mm.

The self-assembling peptide, the nanofiber comprising self-assembly of the peptide, and the gel comprising self-assembly of the peptide of the present invention can be used for cosmetics (skin care articles, hair care articles, and the like), substrates for cell culture (those usable for screening for development of medicaments, regenerative medicine, or the like), medicaments and medical devices (preparations of decubitus, injectable agents for bone filling and aesthetic, reconstructive, and plastic surgery (auxiliary agents for ophthalmic surgery, artificial vitreum, artificial lens, articular lubricants, ophthalmic solutions, DDS substrates, styptic agents, and the like), water-retention agents for wetting, desiccants, or coating agents for medical devices and the like.

EXAMPLES

Production Example 1

Synthesis of Peptide

Peptide No. 1 (sequence-RASARADARASARADA, SEQ ID NO: 1) was synthesized in the following manner in accordance with a Fmoc solid phase synthesis method.

1) Preparation of Solid Phase Carrier Resin

A reaction vessel on a solid phase synthesizer (trade name: Solid Organic Synthesizer CCS-150M, manufactured by EYELA) was charged with 400 mg of a solid phase carrier resin for peptide synthesis CLEAR™-Amide Resin (code no.: RCY-1250-PI, 100 to 200 mesh, 4-(2,4-dimethoxyphenyl-fluorenylmethyloxycarbonyl-aminomethyl)phenoxyacetyl-norleucyl-CLEAR Resin, manufactured by PEPTIDES INSTITUTE.

Next, 5 mL of dichloromethane (manufactured by Wako Pure Chemical Industries, Ltd.) was added to the solid phase carrier resin. The resulting mixture was stirred at room temperature for 10 minutes, and the solid phase carrier resin was allowed to swell. The resulting product was subjected to suction filtration, thereby removing dichloromethane. Further, the procedures of swelling the solid phase carrier resin by dichloromethane and removing the dichloromethane were carried out.

2) Coupling of Amino Acids

The product obtained in the above 1) was stirred at room temperature for 1 minute in the presence of 5 mL of N,N-dimethylformamide (DMF) (manufactured by Wako Pure Chemical Industries, Ltd.). Next, the resulting product was subjected to suction filtration, thereby removing the DMF. Thereafter, the procedures of stirring in the presence of the DMF and removing the DMF (hereinafter referred to as "DMF treatment") were carried out additional 4 times.

Five milliliters of a mixed solvent of piperidine (manufactured by Wako Pure Chemical Industries, Ltd.)/DMF (piperidine:DMF=1:4 (volume ratio)) was added to the resulting product, and the mixture obtained was stirred at room temperature for 3 minutes, thereby removing a fluorenylmethyloxycarbonyl (Fmoc) group in the solid phase carrier resin. The resulting product was subjected to suction filtration to remove the mixed solvent. Further, the procedures of removing the Fmoc group and removing the mixed solvent were carried out in the same manner. Subsequently, the procedures of removing the Fmoc group and removing the mixed solvent were carried out in the same manner except that the stirring time was changed to 15 minutes.

Thereafter, the resulting product was subjected to a DMF treatment in the same manner as above. The DMF treatment was carried out 5 times.

The resulting solid phase carrier resin, 3 mL of a DMF solution containing a Fmoc amino acid derivative (manufactured by PEPTIDES INSTITUTE, trade name: Fmoc-Ala.H$_2$O (9-fluorenylmethyloxycarbonyl-L-alanine-monohydrate) in an amount three times equivalent (0.384 mmol) of an active terminal of the solid phase carrier resin, 1 mL of a DMF solution containing 128 mM 1-hydroxy-7-azabenzotriazole (HOAt), and 1 mL of a DMF solution containing 384 mM N,N'-diisopropylcarbodiimide (DIPCDI) were mixed, while stirring for 2 hours. The resulting product was subjected to suction filtration to remove the reaction solution. In accordance with the amino acid sequence of Peptide No. 1, the same procedures were repeated using a Fmoc derivative corresponding to the desired amino acid residue as the Fmoc amino acid derivative.

The resulting product was subjected to a DMF treatment in the same manner as above. Here, the DMF treatment was repeated 5 times.

A DMF solution containing 768 mM acetic anhydride (manufactured by Nacalai Tesque, Inc.) (amount corresponding to 10 times equivalent of an active terminal in the product) was added to the resulting product, and the mixture was stirred at room temperature for 2 hours. The resulting product was subjected to suction filtration to remove the reaction solution. The resulting product was subjected to a DMF treatment in the same manner as above. The DMF treatment was repeated 5 times.

Thereafter, a dichloromethane treatment was carried out by adding 5 mL of dichloromethane to the resulting product, and stirring the mixture at room temperature for 10 minutes. Thereafter, the resulting product was subjected to suction filtration. The dichloromethane treatment and suction filtration mentioned above were repeated 20 times.

The resin obtained was dried, and transferred into a vial. To the vial were added 9.5 mL of a 95% by volume trifluoroacetic acid (manufactured by Nacalai Tesque, Inc.), 0.85 mL of 1,2-ethanedithiol (manufactured by TCI Organic Chemicals), 0.5 mL of thioanisole (manufactured by TCI Organic Chemicals), and 0.5 mL of water. Thereafter, the resulting mixture was stirred for 3 hours, thereby cleaving the intended peptide from the resin.

To the resulting peptide-containing solution was added 100 mL of diethyl ether (manufactured by Nacalai Tesque, Inc.) (about 10 times the volume of the peptide-containing solution). The resulting product was centrifuged at 3500 r/min at room temperature for 5 minutes to remove the supernatant. To the resulting precipitates was added 50 mL of diethyl ether, and the mixture was stirred at room temperature for 10 minutes. The resulting mixture was centrifuged at 3500 r/min at room temperature for 5 minutes to remove the supernatant. The resulting precipitates were vacuum-dried to give 200 mg of a peptide.

Production Example 2

Synthesis of Peptide

The same procedures as in Production Example 1 mentioned above were carried out to synthesize peptides of Peptide Nos. 2 to 12 listed in Table 8 given hereinbelow.

TABLE 8

| Peptide No. | Amino Acid Sequence | SEQ ID NO: |
|---|---|---|
| 1 | RASARADARASARADA | 1 |
| 2 | RANARADARANARADA | 2 |
| 3 | RAAARADARAAARADA | 3 |
| 4 | RASARADARADARASA | 4 |
| 5 | RADARASARASARADA | 5 |
| 6 | RASARASARASARADA | 6 |
| 7 | RASARADARASA | 7 |
| 8 | KASAKAEAKASAKAEA | 8 |
| 9 | SAEAKAEASAEAKAEA | 9 |
| 10 | RADARADARADARADA | 10 |
| 11 | RFDFRFDFRFDFRFDF | 11 |
| 12 | HKHQHDHKHQHDHKHQHD | 12 |

Reference Example 1

Calculation of Charge of Peptide

In accordance with the method of Lehninger [*Biochimie,* 1979], the charge of the overall peptide at each pH was calculated. The method of Lehninger was performed using a program utilizable on a website for EMBL WWW Gateway to Isoelectric Point Service (http://www.embl-heidelberg.de/cgi/pi-wrapper.pl).

Here, since alanine, valine, asparagine and glutamine are uncharged amino acids, these amino acids could not be distinguished by the program. Therefore, these amino acids were calculated assuming that these amino acids were the same. In addition, in the program, the calculation was made assuming that both of the terminals of the peptide molecule are an amino group and a carboxyl group, respectively, and the charge on the terminal portions was corrected by subtracting a calculated value for polyalanine (charged only at both of the terminals) having the same degree of polymerization as the self-assembling peptide from the calculated value of the self-assembling peptide. By the correction, the influences of each of the amino group and the carboxyl group at the terminals of the peptide were eliminated, so that a value approximating a more realistic structure was obtained. The calculated values of charge at pH of 7.0 of each of Peptide Nos. 1 to 12 are shown in Table 9.

TABLE 9

| Peptide No. | Net Charge at pH 7.0 |
|---|---|
| 1 | +2 |
| 2 | +2 |
| 3 | +2 |
| 4 | +2 |
| 5 | +2 |
| 6 | +3 |
| 7 | +2 |
| 8 | +2 |
| 9 | −2 |
| 10 | 0 |
| 11 | 0 |
| 12 | 0.8 |

As a result, as shown in Table 9, it could be confirmed that the charge at a pH of 7.0 of Peptide Nos. 1 to 9 given above was non-zero (0). Here, although the charge at a pH of 7.0 of Peptide No. 12 is non-zero (0), the peptide is a peptide not having a nonpolar amino acid residue, so that the peptide is not a peptide of the present invention.

Reference Example 2

Confirmation of Formability of Beta (β)-Sheet Structure of Peptide

The formation of each of the beta (β)-sheet structures of Peptide Nos. 1 to 9 and 12 synthesized in Production Examples 1 and 2 mentioned above was confirmed in accordance with circular dichroism measurement method. Concretely, each of the peptides was dissolved in 0.1 M Tris-HCl (pH 7.5) to prepare a $3\times10^{-3}$ M peptide solution. The resulting peptide solution was filled into a quartz cell having an optical path length of 0.5 mm (manufactured by JASCO, trade name: 110J cylindrical cell, volume: 0.04 mL), and the quartz cell was set in trade name J-820K Spectropolarimeter (manufactured by JASCO), and the molar ellipticities at 195 to 260 nm for the peptide solutions were determined in accordance with the circular dichroism measurement method. The results are shown in FIG. 1.

Figure 1:
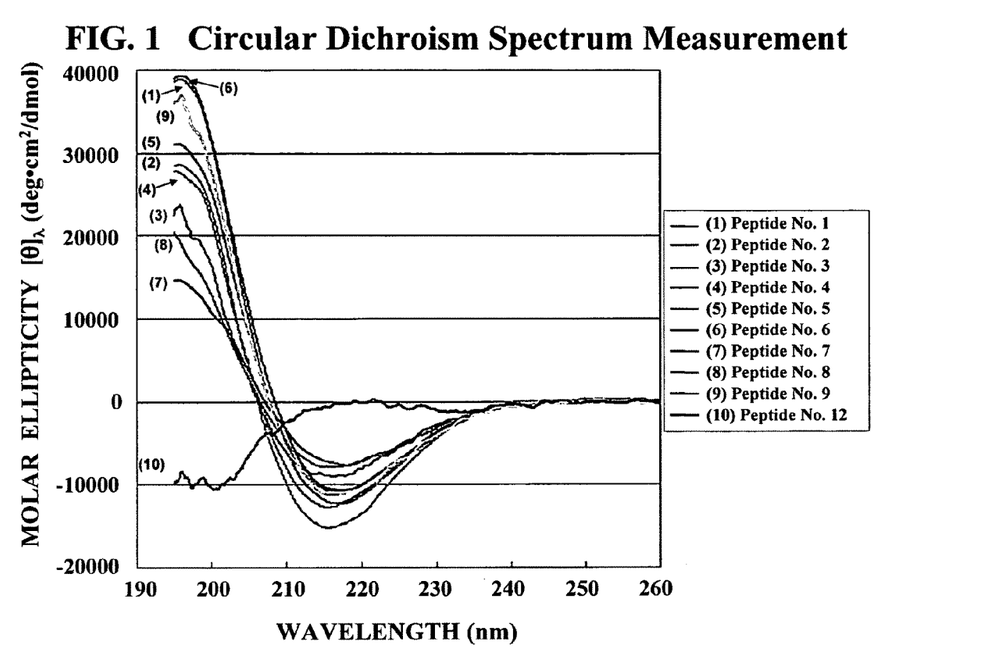
FIG. 1 is a graph showing the molar ellipticity at 195 to 260 nm of a peptide aqueous solution, wherein (1) is a molar ellipticity of a $3\times10^{-3}$ M aqueous solution of Peptide No. 1, (2) is that of Peptide No. 2, (3) is that of Peptide No. 3, (4) is that of Peptide No. 4, (5) is that of Peptide No. 5, (6) is that of Peptide No. 6, (7) is that of Peptide No. 7, (8) is that of Peptide No. 8, (9) is that of Peptide No. 9, and (10) is that of Peptide No. 12.

As a result, as shown in FIG. 1, Peptide Nos. 1 to 9 mentioned above had negative molar ellipticities at 216 nm. Therefore, it could be seen that Peptide Nos. 1 to 9 mentioned above formed beta(β)-sheet structures in an aqueous solution. On the other hand, it could be seen that Peptide No. 12 mentioned above did not form a beta(β)-sheet structure.

Example 1

Confirmation of Nanofiber Formation

Peptide Nos. 1 to 9 synthesized in Production Examples 1 and 2 were dissolved in 0.1 M Tris-HCl (pH 7.5) to respectively prepare a 0.5% by weight peptide solution. The resulting peptide solution was diluted with 0.1 M Tris-HCl (pH 7.5), so as to have a 1/20 concentration.

One microliter of the resulting dilution was dropped on a cleaved mica substrate. Thereafter, an excess peptide on the mica substrate was rinsed off with ion-exchanged water. Next, the substrate was dried at room temperature (25° C.).

The peptide on the dried mica substrate was observed with an atomic force microscope (trade name: NanoScope IIIa, manufactured by Digital Instrument). The results are shown in FIG. 2.

Figure 2:
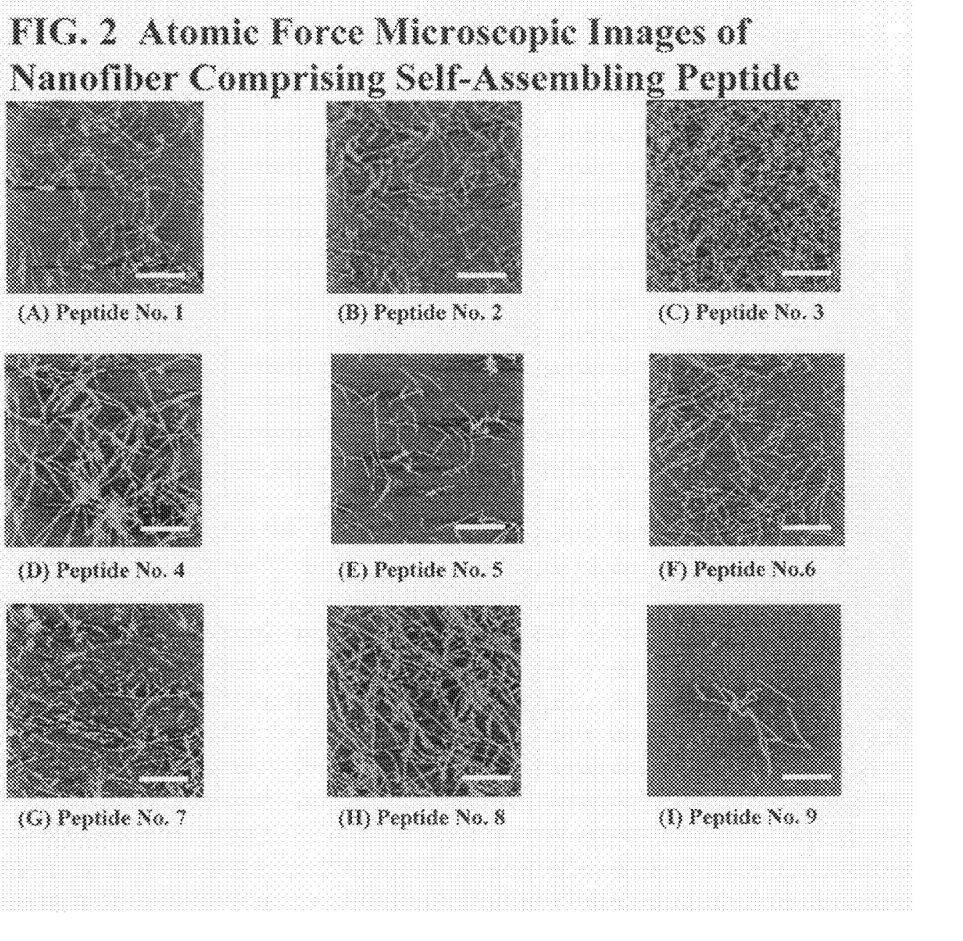
FIG. 2 is a photograph of nanofiber in a peptide aqueous solution observed with an atomic force microscope, wherein a panel (A) is a photograph of a 0.5% by weight aqueous solution of Peptide No. 1, a panel (B) is that of Peptide No. 2, a panel (C) is that of Peptide No. 3, a panel (D) is that of Peptide No. 4, a panel (E) is that of Peptide No. 5, a panel (F) is that of Peptide No. 6, a panel (G) is that of Peptide No. 7, a panel (H) is that of Peptide No. 8, and a panel (I) is that of Peptide No. 9. In the figure, the scale bar represents 500 nm.

As shown in FIG. 2, it could be seen that all of Peptide Nos. 1 to 9 mentioned above self-assembled to form nanofiber.

Test Example 1

Confirmation 1 of Gel Formation

The storage elastic modulus G' and the loss elastic modulus G" of a 0.5% by weight peptide (Peptide Nos. 1 to 10 mentioned above)-containing aqueous solution were determined with an instrument under the trade name of AR1000 (manufactured by TA Instruments Japan). Concretely, 800 μL of a 0.5% by weight peptide-containing aqueous solution, which was allowed to stand at room temperature for one day, was placed on an iron plate, and an iron cone (diameter: 40 mm, angle of cone: 2°) was placed over the 0.5% by weight peptide-containing aqueous solution. Next, the 0.5% by weight peptide-containing aqueous solution was compressed, and a stress applied to a motor was monitored when the iron cone was rotated, while varying the frequency of the cone within the range of 0.1 to 10 rad/sec. The results are shown in Table 10.

quency of the cone was varied. Therefore, it could be seen that Peptide Nos. 1 to 9 mentioned above formed into gel even while varying the frequency within at least the range specified above. As shown in Table 10, it could be seen that Peptide No. 10 (Comparative Example 1), of which charge at a pH 7.0 is 0, formed the gel in an acidic aqueous solution.

Test Example 2

Confirmation 2 of Gel Formation

Peptide Nos. 1, 2, 4, 5, 6, 10 and 11 synthesized in Production Examples 1 and 2 were dissolved in each of aqueous solutions listed in Table 11. A 1.5 mL test tube was charged with 1 mL of the resulting peptide-containing aqueous solution. Next, the test tube was allowed to stand at 37° C. for 24 hours.

Thereafter, under conditions where the test tube was placed up-side-down, those in which the contents did not drop off

TABLE 10

Determination of Dynamic Viscoelasticity of Self-Assembling Peptide Aqueous Solution (0.5 wt %)

| | Peptide No. | pH of Aqueous Solution | | Angular Frequency (rad/sec) | | | | | | | | | | |
|---|---|---|---|---|---|---|---|---|---|---|---|---|---|---|
| | | | | 0.10 | 0.16 | 0.25 | 0.40 | 0.63 | 1.00 | 1.59 | 2.51 | 3.98 | 6.31 | 9.99 |
| Comp. Ex. 1 | 10 | 3.5 | G'(Pa) | 14.75 | 14.05 | 13.78 | 13.64 | 13.69 | 13.74 | 13.79 | 13.82 | 13.93 | 14.06 | 13.81 |
| | | | G"(Pa) | 0.52 | 0.51 | 0.54 | 0.55 | 0.54 | 0.58 | 0.67 | 0.55 | 0.70 | 0.83 | 0.86 |
| Ex. 2 | 1 | 7.43 | G'(Pa) | 6.69 | 6.68 | 6.92 | 7.36 | 7.71 | 8.11 | 8.44 | 8.83 | 9.22 | 9.65 | 9.93 |
| | | | G"(Pa) | 1.47 | 1.66 | 1.79 | 1.83 | 1.85 | 1.82 | 1.83 | 1.83 | 1.86 | 1.94 | 2.10 |
| Ex. 3 | 2 | 7.45 | G'(Pa) | 17.29 | 17.88 | 18.51 | 19.12 | 19.67 | 20.23 | 20.86 | 21.51 | 22.17 | 22.88 | 23.72 |
| | | | G"(Pa) | 2.58 | 2.59 | 2.49 | 2.42 | 2.43 | 2.43 | 2.40 | 2.41 | 2.44 | 2.50 | 2.61 |
| Ex. 4 | 3 | 7.55 | G'(Pa) | 9.44 | 9.56 | 9.75 | 9.95 | 10.25 | 10.55 | 10.89 | 11.22 | 11.49 | 11.67 | 11.41 |
| | | | G"(Pa) | 2.23 | 2.00 | 1.88 | 1.79 | 1.72 | 1.69 | 1.70 | 1.72 | 1.84 | 1.94 | 2.13 |
| Ex. 5 | 4 | 7.42 | G'(Pa) | 25.64 | 25.58 | 25.81 | 26.11 | 26.52 | 27.13 | 27.61 | 28.10 | 28.49 | 28.89 | 28.98 |
| | | | G"(Pa) | 2.08 | 2.18 | 2.18 | 2.27 | 2.24 | 2.09 | 2.07 | 2.05 | 1.98 | 2.04 | 2.13 |
| Ex. 6 | 5 | 7.42 | G'(Pa) | 4.48 | 4.99 | 5.40 | 5.76 | 6.08 | 6.40 | 6.74 | 7.11 | 7.32 | 7.51 | 7.09 |
| | | | G"(Pa) | 1.65 | 1.72 | 1.71 | 1.69 | 1.67 | 1.68 | 1.70 | 1.71 | 1.84 | 1.96 | 2.16 |
| Ex. 7 | 6 | 7.49 | G'(Pa) | 5.64 | 5.93 | 6.24 | 6.52 | 6.83 | 7.13 | 7.39 | 7.70 | 7.95 | 8.15 | 7.92 |
| | | | G"(Pa) | 1.52 | 1.46 | 1.46 | 1.43 | 1.41 | 1.40 | 1.42 | 1.44 | 1.53 | 1.64 | 1.85 |
| Ex. 8 | 7 | 7.49 | G'(Pa) | 3.61 | 3.70 | 3.80 | 3.90 | 4.01 | 4.13 | 4.26 | 4.36 | 4.47 | 4.44 | 3.78 |
| | | | G"(Pa) | 0.97 | 1.00 | 1.00 | 1.01 | 1.05 | 1.08 | 1.12 | 1.19 | 1.26 | 1.30 | 1.10 |
| Ex. 9 | 8 | 7.51 | G'(Pa) | 6.93 | 6.97 | 6.96 | 7.00 | 7.06 | 7.09 | 7.18 | 7.36 | 7.43 | 7.58 | 7.72 |
| | | | G"(Pa) | 0.72 | 0.62 | 0.59 | 0.57 | 0.57 | 0.61 | 0.62 | 0.72 | 0.69 | 0.78 | 0.88 |
| Ex. 10 | 9 | 7.23 | G'(Pa) | 4.73 | 4.46 | 4.36 | 4.35 | 4.40 | 4.53 | 4.67 | 4.85 | 5.04 | 5.17 | 5.23 |
| | | | G"(Pa) | 0.86 | 0.82 | 0.82 | 0.83 | 0.87 | 0.90 | 0.95 | 1.02 | 1.01 | 1.07 | 1.15 |

As shown in Table 10, all of Peptide Nos. 1 to 9 (Examples 2 to 10) mentioned above satisfied the formula G'>G". In addition, in Peptide Nos. 1 to 9 mentioned above, the values of G' and G" were relatively constant even while the frequency were evaluated as the gel formation being "excellent", and those in which the contents dropped off were evaluated as being "poor." The results are shown in Table 11.

TABLE 11

| | Peptide No. | Aquoeus Solution | | | Peptide Conc. (% by weight) in Aqueous Solution | pH of Aqueous Solution After Dissolving Peptide | Gel Formation |
|---|---|---|---|---|---|---|---|
| | | Kind | Concentration (M) | pH | | | |
| Ex. 11 | 1 | PBS | — | 7.4 | 0.5 | 6.54 | Excellent |
| 12 | | Tris-HCl | 0.05 | 7.5 | 0.5 | 6.92 | Excellent |
| 13 | | | 0.1 | 7.5 | 0.5 | 7.15 | Excellent |
| 14 | | | 0.2 | 7.5 | 0.5 | 7.25 | Excellent |
| 15 | | | 0.4 | 7.5 | 0.5 | 7.29 | Excellent |
| 16 | | | 0.6 | 7.5 | 0.5 | 7.3 | Excellent |
| 17 | | | 0.8 | 7.5 | 0.5 | 7.3 | Excellent |
| 18 | | | 1 | 7.5 | 0.5 | 7.3 | Excellent |
| 19 | | D-MEM/F12(1:1) Medium | — | 7.5 | 0.5 | 7.37 | Excellent |
| 20 | 2 | Tris-HCl | 0.1 | 7.5 | 0.5 | 7.45 | Excellent |
| 21 | 4 | PBS | — | 7.4 | 0.5 | 6.55 | Excellent |
| 22 | | Tris-HCl | 0.05 | 7.5 | 0.5 | 6.93 | Excellent |

TABLE 11-continued

| | Peptide No. | Aquoeus Solution Kind | Concentration (M) | pH | Peptide Conc. (% by weight) in Aqueous Solution | pH of Aqueous Solution After Dissolving Peptide | Gel Formation |
|---|---|---|---|---|---|---|---|
| | 23 | | 0.1 | 7.5 | 0.5 | 7.26 | Excellent |
| | 24 | | 0.2 | 7.5 | 0.5 | 7.29 | Excellent |
| | 25 | | 0.4 | 7.5 | 0.5 | 7.31 | Excellent |
| | 26 | | 0.6 | 7.5 | 0.5 | 7.31 | Excellent |
| | 27 | | 0.8 | 7.5 | 0.5 | 7.31 | Excellent |
| | 28 | | 1 | 7.5 | 0.5 | 7.31 | Excellent |
| | 29 | 5 Tris-HCl | 0.1 | 7.5 | 0.5 | 7.42 | Excellent |
| | 30 | 6 Tris-HCl | 0.1 | 7.5 | 0.5 | 7.49 | Excellent |
| Comp. | 2 | 10 PBS | — | 7.4 | 0.5 | 6.31 | Poor |
| Ex. | 3 | 11 PBS | — | 7.4 | 0.5 | 6.6 | Poor |

As shown in Table 11, it could be seen that Peptide Nos. 1, 2, 4, 5 and 6 (Examples 11 to 30) formed into gel in various neutral aqueous solutions. On the other hand, it could be seen that Peptide Nos. 10 and 11 (Comparative Examples 2 and 3), of which charge at a pH 7.0 is 0, did not form into gel in a neutral aqueous solution.

Example 31

Determination of Visible Light Transmittance of Peptide Aqueous Solutions

Peptide Nos. 1 to 9 synthesized in Production Examples 1 and 2 were dissolved in 0.1 M Tris-HCl (pH 7.5), to prepare a gel composed of a 0.5% by weight peptide solution. The visible light transmittance of the prepared gel within the range of from 380 to 780 nm was determined using a cell having an optical path length of 10 mm and trade name V-550 UV/VIS Spectrometer (manufactured by JASCO). An average of the visible light transmittance within the above range is shown in Table 12.

TABLE 12

| Peptide No. | Visible Light Transmittance (%) |
|---|---|
| 1 | 97 |
| 2 | 77 |
| 3 | 91 |
| 4 | 92 |
| 5 | 78 |
| 6 | 97 |
| 7 | 97 |
| 8 | 94 |
| 9 | 93 |

As shown in Table 12, all of the gels comprising each of Peptide Nos. 1 to 9 showed high visible light transmittance. Therefore, it could be seen that each of Peptide Nos. 1 to 9 mentioned above formed a transparent gel. In addition, of the above gels, the gel comprising each of Peptide Nos. 1, 4, 6, or 7 was allowed to stand at room temperature for 2 months, and the visible light transmittance was determined in the same manner as above. As a result, an average thereof was respectively 88, 87, 91, or 93%/cm, and the decreasing ratio was respectively 9.3, 5.4, 6.2, or 4.1%. In other words, the gel after 2 months passed from the preparation also maintained high visible light transmittance. Therefore, it could be seen that the gel comprising each of Peptide No. 1, 4, 6, or 7 was stable for a long period of time without becoming white turbid or the like.

INDUSTRIAL APPLICABILITY

The self-assembling peptide, the nanofiber comprising self-assembly of the peptide, and the gel comprising self-assembly of the self-assembling peptide of the present invention can be used for cosmetics (skin care articles, hair care articles, and the like), substrates for cell culture (those usable for screening for development of medicaments, regenerative medicine, or the like), medicaments and medical devices (preparations of decubitus, injectable agents for bone filling and aesthetic, reconstructive, and plastic surgery (auxiliary agents for ophthalmic surgery, artificial vitreum, artificial lens, articular lubricants, ophthalmic solutions, DDS substrates, styptic agents, and the like), water-retention agents for wetting, desiccants, or coating agents for medical devices and the like.

SEQUENCE LISTING FREE TEXT

SEQ ID NO: 1 of Sequence Listing is a self-assembling peptide of the present invention.
SEQ ID NO: 2 of Sequence Listing is a self-assembling peptide of the present invention.
SEQ ID NO: 3 of Sequence Listing is a self-assembling peptide of the present invention.
SEQ ID NO: 4 of Sequence Listing is a self-assembling peptide of the present invention.
SEQ ID NO: 5 of Sequence Listing is a self-assembling peptide of the present invention.
SEQ ID NO: 6 of Sequence Listing is a self-assembling peptide of the present invention.

SEQ ID NO: 7 of Sequence Listing is a self-assembling peptide of the present invention.

SEQ ID NO: 8 of Sequence Listing is a self-assembling peptide of the present invention.

SEQ ID NO: 9 of Sequence Listing is a self-assembling peptide of the present invention.

SEQ ID NO: 10 of Sequence Listing is a peptide, which is not self-assembling peptide of the present invention.

SEQ ID NO: 11 of Sequence Listing is a peptide, which is not self-assembling peptide of the present invention.

SEQ ID NO: 12 of Sequence Listing is a peptide, which is not self-assembling peptide of the present invention.

SEQUENCE LISTING (444 sequences)

SEQ ID NO: 1 - protein, 16 aa, Artificial Sequence
  Synthetic self-assembling peptide of the invention
RASARADARASARADA

SEQ ID NO: 2 - protein, 16 aa, Artificial Sequence
  Synthetic self-assembling peptide of the invention
RANARADARANARADA

SEQ ID NO: 3 - protein, 16 aa, Artificial Sequence
  Synthetic self-assembling peptide of the invention
RAAARADARAAARADA

SEQ ID NO: 4 - protein, 16 aa, Artificial Sequence
  Synthetic self-assembling peptide of the invention
RASARADARADARASA

SEQ ID NO: 5 - protein, 16 aa, Artificial Sequence
  Synthetic self-assembling peptide of the invention
RADARASARASARADA

SEQ ID NO: 6 - protein, 16 aa, Artificial Sequence
  Synthetic self-assembling peptide of the invention
RASARASARASARADA

SEQ ID NO: 7 - protein, 12 aa, Artificial Sequence
  Synthetic self-assembling peptide of the invention
RASARADARASA

SEQ ID NO: 8 - protein, 16 aa, Artificial Sequence
  Synthetic self-assembling peptide of the invention
KASAKAEAKASAKAEA

SEQ ID NO: 9 - protein, 16 aa, Artificial Sequence
  Synthetic self-assembling peptide of the invention
SAEAKAEASAEAKAEA

SEQ ID NO: 10 - protein, 16 aa, Artificial Sequence
  Synthetic peptide which is not a peptide of the invention
RADARADARADARADA

SEQ ID NO: 11 - protein, 16 aa, Artificial Sequence
  Synthetic peptide which is not a peptide of the invention
RFDFRFDFRFDFRFDF

SEQ ID NO: 12 - protein, 18 aa, Artificial Sequence
  Synthetic peptide which is not a peptide of the invention
HKHQHDHKHQHDHKHQHD

SEQ ID NO: 13 - protein, 16 aa, Artificial Sequence
  Synthetic peptide 1-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXDXRXDX

SEQ ID NO: 14 - protein, 16 aa, Artificial Sequence
  Synthetic peptide 2-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXDXRXXXRXDX

SEQ ID NO: 15 - protein, 16 aa, Artificial Sequence
  Synthetic peptide 3-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXDXRXDXRXXX

SEQ ID NO: 16 - protein, 16 aa, Artificial Sequence
  Synthetic peptide 4-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXRXXXRXXXRXDX

SEQ ID NO: 17 - protein, 16 aa, Artificial Sequence
  Synthetic peptide 5-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXRXXXRXDXRXXX

SEQ ID NO: 18 - protein, 16 aa, Artificial Sequence
  Synthetic peptide 6-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXRXDXRXXXRXXX

SEQ ID NO: 19 - protein, 16 aa, Artificial Sequence
  Synthetic peptide 7-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXXXRXDX

SEQ ID NO: 20 - protein, 16 aa, Artificial Sequence
  Synthetic peptide 8-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXDXRXXX

SEQ ID NO: 21 - protein, 16 aa, Artificial Sequence
  Synthetic peptide 9-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXDXRXXXRXXX

SEQ ID NO: 22 - protein, 16 aa, Artificial Sequence
  Synthetic peptide 10-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXRXXXRXXXRXXX

SEQ ID NO: 23 - protein, 12 aa, Artificial Sequence
  Synthetic peptide 11-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXRXXXRXDX

SEQ ID NO: 24 - protein, 12 aa, Artificial Sequence
  Synthetic peptide 12-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXRXDXRXXX

SEQ ID NO: 25 - protein, 12 aa, Artificial Sequence
  Synthetic peptide 13-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXDXRXXXRXXX

SEQ ID NO: 26 - protein, 16 aa, Artificial Sequence
  Synthetic peptide 14-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXRXDXRXDX

SEQ ID NO: 27 - protein, 16 aa, Artificial Sequence
  Synthetic peptide 15-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXRXDXXXDXRXDX

SEQ ID NO: 28 - protein, 16 aa, Artificial Sequence
  Synthetic peptide 16-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXRXDXRXDXXXDX

SEQ ID NO: 29 - protein, 16 aa, Artificial Sequence
  Synthetic peptide 17-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXXXDXXXDXRXDX

SEQ ID NO: 30 - protein, 16 aa, Artificial Sequence
  Synthetic peptide 18-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXXXDXRXDXXXDX

SEQ ID NO: 31 - protein, 16 aa, Artificial Sequence
  Synthetic peptide 19-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXRXDXXXDXXXDX

SEQ ID NO: 32 - protein, 16 aa, Artificial Sequence
  Synthetic peptide 20-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXXXDXRXDX

SEQ ID NO: 33 - protein, 16 aa, Artificial Sequence
  Synthetic peptide 21-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXRXDXXXDX

SEQ ID NO: 34 - protein, 16 aa, Artificial Sequence
  Synthetic peptide 22-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXRXDXXXDXXXDX

SEQ ID NO: 35 - protein, 16 aa, Artificial Sequence
  Synthetic peptide 23-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXDXXXDXXXDXXXDX

SEQ ID NO: 36 - protein, 12 aa, Artificial Sequence
  Synthetic peptide 24-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXXXDXRXDX

SEQ ID NO: 37 - protein, 12 aa, Artificial Sequence
  Synthetic peptide 25-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXRXDXXXDX

SEQ ID NO: 38 - protein, 12 aa, Artificial Sequence
  Synthetic peptide 26-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXDXXXDXXXDX

SEQ ID NO: 39 - protein, 16 aa, Artificial Sequence
  Synthetic peptide 27-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXDXDX

SEQ ID NO: 40 - protein, 16 aa, Artificial Sequence
  Synthetic peptide 28-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXDXRXRXXXDX

SEQ ID NO: 41 - protein, 16 aa, Artificial Sequence
  Synthetic peptide 29-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXDXRXRXDXXX

SEQ ID NO: 42 - protein, 16 aa, Artificial Sequence
  Synthetic peptide 30-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXDXXXRXRXXXDX

SEQ ID NO: 43 - protein, 16 aa, Artificial Sequence
  Synthetic peptide 31-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXDXXXRXRXDXXX

SEQ ID NO: 44 - protein, 16 aa, Artificial Sequence
  Synthetic peptide 32-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXDXDXRXRXXXXX

SEQ ID NO: 45 - protein, 16 aa, Artificial Sequence
  Synthetic peptide 33-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXXXDX

SEQ ID NO: 46 - protein, 16 aa, Artificial Sequence
  Synthetic peptide 34-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXDXXX

SEQ ID NO: 47 - protein, 16 aa, Artificial Sequence
  Synthetic peptide 35-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXDXRXRXXXXX

SEQ ID NO: 48 - protein, 16 aa, Artificial Sequence
  Synthetic peptide 36-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXDXXXRXRXXXXX

SEQ ID NO: 49 - protein, 16 aa, Artificial Sequence
  Synthetic peptide 37-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXRXRXDXDX

SEQ ID NO: 50 - protein, 16 aa, Artificial Sequence
  Synthetic peptide 38-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXDXDXXXRXDXDX

SEQ ID NO: 51 - protein, 16 aa, Artificial Sequence
  Synthetic peptide 39-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXDXDXRXXXDXDX

SEQ ID NO: 52 - protein, 16 aa, Artificial Sequence
  Synthetic peptide 40-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXDXDXXXRXDXDX

SEQ ID NO: 53 - protein, 16 aa, Artificial Sequence
  Synthetic peptide 41-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXDXDXRXXXDXDX

SEQ ID NO: 54 - protein, 16 aa, Artificial Sequence
  Synthetic peptide 42-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXDXDXXXXXDXDX

SEQ ID NO: 55 - protein, 16 aa, Artificial Sequence
  Synthetic peptide 43-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXXXRXDXDX

SEQ ID NO: 56 - protein, 16 aa, Artificial Sequence
  Synthetic peptide 44-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXRXXXDXDX

SEQ ID NO: 57 - protein, 16 aa, Artificial Sequence
  Synthetic peptide 45-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXDXDXXXXXDXDX

SEQ ID NO: 58 - protein, 16 aa, Artificial Sequence
  Synthetic peptide 46-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXDXDXXXXXDXDX

SEQ ID NO: 59 - protein, 12 aa, Artificial Sequence
  Synthetic peptide 47-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXXXXXDX

SEQ ID NO: 60 - protein, 12 aa, Artificial Sequence
  Synthetic peptide 48-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXXXDXXX

SEQ ID NO: 61 - protein, 12 aa, Artificial Sequence
  Synthetic peptide 49-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXDXXXXX

SEQ ID NO: 62 - protein, 12 aa, Artificial Sequence
  Synthetic peptide 50-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXRXDXDXDX

SEQ ID NO: 63 - protein, 12 aa, Artificial Sequence
  Synthetic peptide 51-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXRXXXDXDXDX

SEQ ID NO: 64 - protein, 12 aa, Artificial Sequence
  Synthetic peptide 52-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXXXDXDXDX

SEQ ID NO: 65 - protein, 16 aa, Artificial Sequence
  Synthetic peptide 53-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXDXDX

SEQ ID NO: 66 - protein, 16 aa, Artificial Sequence
  Synthetic peptide 54-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXDXXXDX

SEQ ID NO: 67 - protein, 16 aa, Artificial Sequence
  Synthetic peptide 55-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXDXDXXX

SEQ ID NO: 68 - protein, 16 aa, Artificial Sequence
  Synthetic peptide 56-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXDXXXXXDX

SEQ ID NO: 69 - protein, 16 aa, Artificial Sequence
  Synthetic peptide 57-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXDXXXDXXX

SEQ ID NO: 70 - protein, 16 aa, Artificial Sequence
  Synthetic peptide 58-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXDXDXXXXX

SEQ ID NO: 71 - protein, 16 aa, Artificial Sequence
  Synthetic peptide 59-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXXXDX

SEQ ID NO: 72 - protein, 16 aa, Artificial Sequence
  Synthetic peptide 60-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXDXXX

SEQ ID NO: 73 - protein, 16 aa, Artificial Sequence
  Synthetic peptide 61-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXDXXXXX

SEQ ID NO: 74 - protein, 16 aa, Artificial Sequence
  Synthetic peptide 62-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXDXXXXXXX

SEQ ID NO: 75 - protein, 16 aa, Artificial Sequence
  Synthetic peptide 63-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXRXRXDXDXDXDX

SEQ ID NO: 76 - protein, 16 aa, Artificial Sequence
  Synthetic peptide 64-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXXXRXDXDXDXDX

SEQ ID NO: 77 - protein, 16 aa, Artificial Sequence
  Synthetic peptide 65-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXRXXXDXDXDXDX

SEQ ID NO: 78 - protein, 16 aa, Artificial Sequence
  Synthetic peptide 66-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXXXRXDXDXDXDX

SEQ ID NO: 79 - protein, 16 aa, Artificial Sequence
  Synthetic peptide 67-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXDXDXDXDX

SEQ ID NO: 80 - protein, 16 aa, Artificial Sequence
  Synthetic peptide 68-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXDXDXDXDX

SEQ ID NO: 81 - protein, 16 aa, Artificial Sequence
  Synthetic peptide 69-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXRXDXDXDXDX

SEQ ID NO: 82 - protein, 16 aa, Artificial Sequence
  Synthetic peptide 70-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXRXXXDXDXDXDX

SEQ ID NO: 83 - protein, 16 aa, Artificial Sequence
  Synthetic peptide 71-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXXXXXDXDXDXDX

SEQ ID NO: 84 - protein, 16 aa, Artificial Sequence
  Synthetic peptide 72-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXXXXXDXDXDXDX

SEQ ID NO: 85 - protein, 16 aa, Artificial Sequence
  Synthetic peptide 73-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXEXRXEX

SEQ ID NO: 86 - protein, 16 aa, Artificial Sequence
  Synthetic peptide 74-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXEXRXXXRXEX

SEQ ID NO: 87 - protein, 16 aa, Artificial Sequence
  Synthetic peptide 75-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXEXRXEXRXXX

SEQ ID NO: 88 - protein, 16 aa, Artificial Sequence
  Synthetic peptide 76-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXRXXXRXXXRXEX

SEQ ID NO: 89 - protein, 16 aa, Artificial Sequence
  Synthetic peptide 77-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXRXXXRXEXRXXX

SEQ ID NO: 90 - protein, 16 aa, Artificial Sequence
  Synthetic peptide 78-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXRXEXRXXXRXXX

SEQ ID NO: 91 - protein, 16 aa, Artificial Sequence
  Synthetic peptide 79-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXXXRXEX

SEQ ID NO: 92 - protein, 16 aa, Artificial Sequence
  Synthetic peptide 80-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXRXEXRXXX

SEQ ID NO: 93 - protein, 16 aa, Artificial Sequence
  Synthetic peptide 81-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXEXRXXXRXXX

SEQ ID NO: 94 - protein, 16 aa, Artificial Sequence
  Synthetic peptide 82-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXRXXXRXXXRXXX

SEQ ID NO: 95 - protein, 12 aa, Artificial Sequence
  Synthetic peptide 83-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXRXXXRXEX

SEQ ID NO: 96 - protein, 12 aa, Artificial Sequence
  Synthetic peptide 84-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXRXEXRXXX

SEQ ID NO: 97 - protein, 12 aa, Artificial Sequence
  Synthetic peptide 85-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXEXRXXXRXXX

SEQ ID NO: 98 - protein, 16 aa, Artificial Sequence
  Synthetic peptide 86-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXRXEXRXEX

SEQ ID NO: 99 - protein, 16 aa, Artificial Sequence
  Synthetic peptide 87-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXRXEXXXEXRXEX

SEQ ID NO: 100 - protein, 16 aa, Artificial Sequence
  Synthetic peptide 88-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXRXEXRXEXXXEX

SEQ ID NO: 101 - protein, 16 aa, Artificial Sequence
  Synthetic peptide 89-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXXXEXXXEXRXEX

SEQ ID NO: 102 - protein, 16 aa, Artificial Sequence
  Synthetic peptide 90-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXXXEXRXEXXXEX

SEQ ID NO: 103 - protein, 16 aa, Artificial Sequence
  Synthetic peptide 91-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXRXEXXXEXXXEX

SEQ ID NO: 104 - protein, 16 aa, Artificial Sequence
  Synthetic peptide 92-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXXXEXRXEX

SEQ ID NO: 105 - protein, 16 aa, Artificial Sequence
  Synthetic peptide 93-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXRXEXXXEX

SEQ ID NO: 106 - protein, 16 aa, Artificial Sequence
  Synthetic peptide 94-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXRXEXXXEXXXEX

SEQ ID NO: 107 - protein, 16 aa, Artificial Sequence
  Synthetic peptide 95-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXEXXXEXXXEXXXEX

SEQ ID NO: 108 - protein, 12 aa, Artificial Sequence
  Synthetic peptide 96-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXXXEXRXEX

SEQ ID NO: 109 - protein, 12 aa, Artificial Sequence
  Synthetic peptide 97-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXRXEXXXEX

SEQ ID NO: 110 - protein, 12 aa, Artificial Sequence
  Synthetic peptide 98-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXEXXXEXXXEX

SEQ ID NO: 111 - protein, 16 aa, Artificial Sequence
  Synthetic peptide 99-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXEXEX

SEQ ID NO: 112 - protein, 16 aa, Artificial Sequence
  Synthetic peptide 100-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXEXRXRXXXEX

SEQ ID NO: 113 - protein, 16 aa, Artificial Sequence
  Synthetic peptide 101-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXEXRXRXEXXX

SEQ ID NO: 114 - protein, 16 aa, Artificial Sequence
  Synthetic peptide 102-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXEXXXRXRXXXEX

SEQ ID NO: 115 - protein, 16 aa, Artificial Sequence
  Synthetic peptide 103-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXEXXXRXRXEXXX

SEQ ID NO: 116 - protein, 16 aa, Artificial Sequence
  Synthetic peptide 104-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXEXEXRXRXXXXX

SEQ ID NO: 117 - protein, 16 aa, Artificial Sequence
  Synthetic peptide 105-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXXXEX

SEQ ID NO: 118 - protein, 16 aa, Artificial Sequence
  Synthetic peptide 106-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXRXRXEXXX

SEQ ID NO: 119 - protein, 16 aa, Artificial Sequence
  Synthetic peptide 107-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXEXRXRXXXXX

SEQ ID NO: 120 - protein, 16 aa, Artificial Sequence
  Synthetic peptide 108-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXEXXXRXRXXXXX

SEQ ID NO: 121 - protein, 16 aa, Artificial Sequence
  Synthetic peptide 109-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXRXRXEXEX

SEQ ID NO: 122 - protein, 16 aa, Artificial Sequence
  Synthetic peptide 110-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXEXEXXXRXEXEX

SEQ ID NO: 123 - protein, 16 aa, Artificial Sequence
  Synthetic peptide 111-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXEXEXRXXXEXEX

SEQ ID NO: 124 - protein, 16 aa, Artificial Sequence
  Synthetic peptide 112-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXEXEXXXRXEXEX

SEQ ID NO: 125 - protein, 16 aa, Artificial Sequence
  Synthetic peptide 113-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXEXEXRXXXEXEX

SEQ ID NO: 126 - protein, 16 aa, Artificial Sequence
  Synthetic peptide 114-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXEXEXXXXXEXEX

SEQ ID NO: 127 - protein, 16 aa, Artificial Sequence
  Synthetic peptide 115-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXXXRXEXEX

SEQ ID NO: 128 - protein, 16 aa, Artificial Sequence
  Synthetic peptide 116-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXRXXXEXEX

SEQ ID NO: 129 - protein, 16 aa, Artificial Sequence
  Synthetic peptide 117-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXEXEXXXXXEXEX

SEQ ID NO: 130 - protein, 16 aa, Artificial Sequence
  Synthetic peptide 118-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXEXEXXXXXEXEX

SEQ ID NO: 131 - protein, 12 aa, Artificial Sequence
  Synthetic peptide 119-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXXXXXEX

SEQ ID NO: 132 - protein, 12 aa, Artificial Sequence
  Synthetic peptide 120-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXXXEXXX

SEQ ID NO: 133 - protein, 12 aa, Artificial Sequence
  Synthetic peptide 121-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXRXRXEXXXXX

SEQ ID NO: 134 - protein, 12 aa, Artificial Sequence
  Synthetic peptide 122-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXRXEXEXEX

SEQ ID NO: 135 - protein, 12 aa, Artificial Sequence
  Synthetic peptide 123-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXRXXXEXEXEX

SEQ ID NO: 136 - protein, 12 aa, Artificial Sequence
  Synthetic peptide 124-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
RXXXXXEXEXEX

SEQ ID NO: 137 - protein, 16 aa, Artificial Sequence
  Synthetic peptide 125-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXEXEX

SEQ ID NO: 138 - protein, 16 aa, Artificial Sequence
  Synthetic peptide 126-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXEXXXEX

SEQ ID NO: 139 - protein, 16 aa, Artificial Sequence
  Synthetic peptide 127-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXEXEXXX

SEQ ID NO: 140 - protein, 16 aa, Artificial Sequence
  Synthetic peptide 128-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXEXXXXXEX

SEQ ID NO: 141 - protein, 16 aa, Artificial Sequence
  Synthetic peptide 129-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXEXXXEXXX

SEQ ID NO: 142 - protein, 16 aa, Artificial Sequence
  Synthetic peptide 130-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXEXEXXXXX

SEQ ID NO: 143 - protein, 16 aa, Artificial Sequence
  Synthetic peptide 131-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXXXEX

SEQ ID NO: 144 - protein, 16 aa, Artificial Sequence
  Synthetic peptide 132-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXXXEXXX

SEQ ID NO: 145 - protein, 16 aa, Artificial Sequence
  Synthetic peptide 133-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXXXEXXXXX

SEQ ID NO: 146 - protein, 16 aa, Artificial Sequence
  Synthetic peptide 134-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXRXRXEXXXXXXX

SEQ ID NO: 147 - protein, 16 aa, Artificial Sequence
  Synthetic peptide 135-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXRXRXEXEXEXEX

SEQ ID NO: 148 - protein, 16 aa, Artificial Sequence
  Synthetic peptide 136-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXXXRXEXEXEXEX

SEQ ID NO: 149 - protein, 16 aa, Artificial Sequence
  Synthetic peptide 137-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXRXXXEXEXEXEX

SEQ ID NO: 150 - protein, 16 aa, Artificial Sequence
  Synthetic peptide 138-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXXXRXEXEXEXEX

SEQ ID NO: 151 - protein, 16 aa, Artificial Sequence
  Synthetic peptide 139-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXRXXXEXEXEXEX

SEQ ID NO: 152 - protein, 16 aa, Artificial Sequence
  Synthetic peptide 140-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXRXXXXXEXEXEXEX

SEQ ID NO: 153 - protein, 16 aa, Artificial Sequence
  Synthetic peptide 141-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXRXEXEXEXEX

SEQ ID NO: 154 - protein, 16 aa, Artificial Sequence
  Synthetic peptide 142-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXRXXXEXEXEXEX

SEQ ID NO: 155 - protein, 16 aa, Artificial Sequence
  Synthetic peptide 143-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXRXXXXXEXEXEXEX

SEQ ID NO: 156 - protein, 16 aa, Artificial Sequence
  Synthetic peptide 144-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
RXXXXXXXEXEXEXEX

SEQ ID NO: 157 - protein, 16 aa, Artificial Sequence
  Synthetic peptide 145-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXDXKXDX

SEQ ID NO: 158 - protein, 16 aa, Artificial Sequence
  Synthetic peptide 146-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXDXKXXXKXDX

SEQ ID NO: 159 - protein, 16 aa, Artificial Sequence
  Synthetic peptide 147-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXDXKXDXKXXX

SEQ ID NO: 160 - protein, 16 aa, Artificial Sequence
  Synthetic peptide 148-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXKXXXKXXXKXDX

SEQ ID NO: 161 - protein, 16 aa, Artificial Sequence
  Synthetic peptide 149-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXKXXXKXDXKXXX

SEQ ID NO: 162 - protein, 16 aa, Artificial Sequence
  Synthetic peptide 150-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXKXDXKXXXKXXX

SEQ ID NO: 163 - protein, 16 aa, Artificial Sequence
  Synthetic peptide 151-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXXXKXDX

SEQ ID NO: 164 - protein, 16 aa, Artificial Sequence
  Synthetic peptide 152-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXDXKXXX

SEQ ID NO: 165 - protein, 16 aa, Artificial Sequence
  Synthetic peptide 153-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXDXKXXXKXXX

SEQ ID NO: 166 - protein, 16 aa, Artificial Sequence
  Synthetic peptide 154-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXKXXXKXXXKXXX

SEQ ID NO: 167 - protein, 12 aa, Artificial Sequence
  Synthetic peptide 155-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXKXXXKXDX

SEQ ID NO: 168 - protein, 12 aa, Artificial Sequence
  Synthetic peptide 156-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXKXDXKXXX

SEQ ID NO: 169 - protein, 12 aa, Artificial Sequence
  Synthetic peptide 157-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXDXKXXXKXXX

SEQ ID NO: 170 - protein, 16 aa, Artificial Sequence
  Synthetic peptide 158-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXKXDXKXDX

SEQ ID NO: 171 - protein, 16 aa, Artificial Sequence
  Synthetic peptide 159-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXKXDXXXDXKXDX

SEQ ID NO: 172 - protein, 16 aa, Artificial Sequence
  Synthetic peptide 160-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXKXDXKXDXXXDX

SEQ ID NO: 173 - protein, 16 aa, Artificial Sequence
  Synthetic peptide 161-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXXXDXXXDXKXDX

SEQ ID NO: 174 - protein, 16 aa, Artificial Sequence
  Synthetic peptide 162-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXXXDXKXDXXXDX

SEQ ID NO: 175 - protein, 16 aa, Artificial Sequence
  Synthetic peptide 163-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXKXDXXXDXXXDX

SEQ ID NO: 176 - protein, 16 aa, Artificial Sequence
  Synthetic peptide 164-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXXXDXKXDX

SEQ ID NO: 177 - protein, 16 aa, Artificial Sequence
  Synthetic peptide 165-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXKXDXXXDX

SEQ ID NO: 178 - protein, 16 aa, Artificial Sequence
  Synthetic peptide 166-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXKXDXXXDXXXDX

SEQ ID NO: 179 - protein, 16 aa, Artificial Sequence
  Synthetic peptide 167-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXDXXXDXXXDXXXDX

SEQ ID NO: 180 - protein, 12 aa, Artificial Sequence
  Synthetic peptide 168-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXXXDXKXDX

SEQ ID NO: 181 - protein, 12 aa, Artificial Sequence
  Synthetic peptide 169-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXKXDXXXDX

SEQ ID NO: 182 - protein, 12 aa, Artificial Sequence
  Synthetic peptide 170-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXDXXXDXXXDX

SEQ ID NO: 183 - protein, 16 aa, Artificial Sequence
  Synthetic peptide 171-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXDXDX

SEQ ID NO: 184 - protein, 16 aa, Artificial Sequence
  Synthetic peptide 172-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXDXKXKXXXDX

SEQ ID NO: 185 - protein, 16 aa, Artificial Sequence
  Synthetic peptide 173-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXDXKXKXDXXX

SEQ ID NO: 186 - protein, 16 aa, Artificial Sequence
  Synthetic peptide 174-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXDXXXKXKXXXDX

SEQ ID NO: 187 - protein, 16 aa, Artificial Sequence
  Synthetic peptide 175-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXDXXXKXKXDXXX

SEQ ID NO: 188 - protein, 16 aa, Artificial Sequence
  Synthetic peptide 176-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXDXDXKXKXXXXX

SEQ ID NO: 189 - protein, 16 aa, Artificial Sequence
  Synthetic peptide 177-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXXXDX

SEQ ID NO: 190 - protein, 16 aa, Artificial Sequence
  Synthetic peptide 178-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXDXXX

SEQ ID NO: 191 - protein, 16 aa, Artificial Sequence
  Synthetic peptide 179-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXDXKXKXXXXX

SEQ ID NO: 192 - protein, 16 aa, Artificial Sequence
  Synthetic peptide 180-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXDXXXKXKXXXXX

SEQ ID NO: 193 - protein, 16 aa, Artificial Sequence
  Synthetic peptide 181-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXKXKXDXDX

SEQ ID NO: 194 - protein, 16 aa, Artificial Sequence
  Synthetic peptide 182-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXDXDXXXKXDXDX

SEQ ID NO: 195 - protein, 16 aa, Artificial Sequence
  Synthetic peptide 183-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXDXDXKXXXDXDX

SEQ ID NO: 196 - protein, 16 aa, Artificial Sequence
  Synthetic peptide 184-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXDXDXXXKXDXDX

SEQ ID NO: 197 - protein, 16 aa, Artificial Sequence
  Synthetic peptide 185-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXDXDXKXXXDXDX

SEQ ID NO: 198 - protein, 16 aa, Artificial Sequence
  Synthetic peptide 186-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXDXDXXXXXDXDX

SEQ ID NO: 199 - protein, 16 aa, Artificial Sequence
  Synthetic peptide 187-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXXXKXDXDX

SEQ ID NO: 200 - protein, 16 aa, Artificial Sequence
  Synthetic peptide 188-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXKXXXDXDX

SEQ ID NO: 201 - protein, 16 aa, Artificial Sequence
  Synthetic peptide 189-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXDXDXXXXXDXDX

SEQ ID NO: 202 - protein, 16 aa, Artificial Sequence
  Synthetic peptide 190-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXDXDXXXXXDXDX

SEQ ID NO: 203 - protein, 12 aa, Artificial Sequence
  Synthetic peptide 191-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXXXXXDX

SEQ ID NO: 204 - protein, 12 aa, Artificial Sequence
  Synthetic peptide 192-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXXXDXXX

SEQ ID NO: 205 - protein, 12 aa, Artificial Sequence
  Synthetic peptide 193-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXDXXXXX

SEQ ID NO: 206 - protein, 12 aa, Artificial Sequence
  Synthetic peptide 194-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXKXDXDXDX

SEQ ID NO: 207 - protein, 12 aa, Artificial Sequence
  Synthetic peptide 195-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXKXXXDXDXDX

SEQ ID NO: 208 - protein, 12 aa, Artificial Sequence
  Synthetic peptide 196-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXXXDXDXDX

SEQ ID NO: 209 - protein, 16 aa, Artificial Sequence
  Synthetic peptide 197-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXDXDX

SEQ ID NO: 210 - protein, 16 aa, Artificial Sequence
  Synthetic peptide 198-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXDXXXDX

SEQ ID NO: 211 - protein, 16 aa, Artificial Sequence
  Synthetic peptide 199-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXDXDXXX

SEQ ID NO: 212 - protein, 16 aa, Artificial Sequence
  Synthetic peptide 200-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXDXXXXXDX

SEQ ID NO: 213 - protein, 16 aa, Artificial Sequence
  Synthetic peptide 201-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXDXXXDXXX

SEQ ID NO: 214 - protein, 16 aa, Artificial Sequence
  Synthetic peptide 202-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXDXDXXXXX

SEQ ID NO: 215 - protein, 16 aa, Artificial Sequence
  Synthetic peptide 203-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXXXDX

SEQ ID NO: 216 - protein, 16 aa, Artificial Sequence
  Synthetic peptide 204-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXDXXX

SEQ ID NO: 217 - protein, 16 aa, Artificial Sequence
  Synthetic peptide 205-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXDXXXXX

SEQ ID NO: 218 - protein, 16 aa, Artificial Sequence
  Synthetic peptide 206-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXDXXXXXXX

SEQ ID NO: 219 - protein, 16 aa, Artificial Sequence
  Synthetic peptide 207-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXKXKXDXDXDXDX

SEQ ID NO: 220 - protein, 16 aa, Artificial Sequence
  Synthetic peptide 208-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXXXKXDXDXDXDX

SEQ ID NO: 221 - protein, 16 aa, Artificial Sequence
  Synthetic peptide 209-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXKXXXDXDXDXDX

SEQ ID NO: 222 - protein, 16 aa, Artificial Sequence
  Synthetic peptide 210-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXXXKXDXDXDXDX

SEQ ID NO: 223 - protein, 16 aa, Artificial Sequence
  Synthetic peptide 211-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXDXDXDXDX

SEQ ID NO: 224 - protein, 16 aa, Artificial Sequence
  Synthetic peptide 212-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXDXDXDXDX

SEQ ID NO: 225 - protein, 16 aa, Artificial Sequence
  Synthetic peptide 213-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXKXDXDXDXDX

SEQ ID NO: 226 - protein, 16 aa, Artificial Sequence
  Synthetic peptide 214-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXKXXXDXDXDXDX

SEQ ID NO: 227 - protein, 16 aa, Artificial Sequence
  Synthetic peptide 215-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXXXXXDXDXDXDX

SEQ ID NO: 228 - protein, 16 aa, Artificial Sequence
  Synthetic peptide 216-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXXXXXDXDXDXDX

SEQ ID NO: 229 - protein, 16 aa, Artificial Sequence
  Synthetic peptide 217-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXEXKXEX

SEQ ID NO: 230 - protein, 16 aa, Artificial Sequence
  Synthetic peptide 218-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXEXKXXXKXEX

SEQ ID NO: 231 - protein, 16 aa, Artificial Sequence
  Synthetic peptide 219-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXEXKXEXKXXX

SEQ ID NO: 232 - protein, 16 aa, Artificial Sequence
  Synthetic peptide 220-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXKXXXKXXXKXEX

SEQ ID NO: 233 - protein, 16 aa, Artificial Sequence
  Synthetic peptide 221-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXKXXXKXEXKXXX

SEQ ID NO: 234 - protein, 16 aa, Artificial Sequence
  Synthetic peptide 222-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXKXEXKXXXKXXX

SEQ ID NO: 235 - protein, 16 aa, Artificial Sequence
  Synthetic peptide 223-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXXXKXEX

SEQ ID NO: 236 - protein, 16 aa, Artificial Sequence
  Synthetic peptide 224-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXKXEXKXXX

SEQ ID NO: 237 - protein, 16 aa, Artificial Sequence
  Synthetic peptide 225-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXEXKXXXKXXX

SEQ ID NO: 238 - protein, 16 aa, Artificial Sequence
  Synthetic peptide 226-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXKXXXKXXXKXXX

SEQ ID NO: 239 - protein, 12 aa, Artificial Sequence
  Synthetic peptide 227-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXKXXXKXEX

SEQ ID NO: 240 - protein, 12 aa, Artificial Sequence
  Synthetic peptide 228-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXKXEXKXXX

SEQ ID NO: 241 - protein, 12 aa, Artificial Sequence
  Synthetic peptide 229-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXEXKXXXKXXX

SEQ ID NO: 242 - protein, 16 aa, Artificial Sequence
  Synthetic peptide 230-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXKXEXKXEX

SEQ ID NO: 243 - protein, 16 aa, Artificial Sequence
  Synthetic peptide 231-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXKXEXXXEXKXEX

SEQ ID NO: 244 - protein, 16 aa, Artificial Sequence
  Synthetic peptide 232-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXKXEXKXEXXXEX

SEQ ID NO: 245 - protein, 16 aa, Artificial Sequence
  Synthetic peptide 233-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXXXEXXXEXKXEX

SEQ ID NO: 246 - protein, 16 aa, Artificial Sequence
  Synthetic peptide 234-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXXXEXKXEXXXEX

SEQ ID NO: 247 - protein, 16 aa, Artificial Sequence
  Synthetic peptide 235-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXKXEXXXEXXXEX

SEQ ID NO: 248 - protein, 16 aa, Artificial Sequence
  Synthetic peptide 236-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXXXEXKXEX

SEQ ID NO: 249 - protein, 16 aa, Artificial Sequence
  Synthetic peptide 237-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXKXEXXXEX

SEQ ID NO: 250 - protein, 16 aa, Artificial Sequence
  Synthetic peptide 238-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXKXEXXXEXXXEX

SEQ ID NO: 251 - protein, 16 aa, Artificial Sequence
  Synthetic peptide 239-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXEXXXEXXXEXXXEX

SEQ ID NO: 252 - protein, 12 aa, Artificial Sequence
  Synthetic peptide 240-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXXXEXKXEX

SEQ ID NO: 253 - protein, 12 aa, Artificial Sequence
  Synthetic peptide 241-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXKXEXXXEX

SEQ ID NO: 254 - protein, 12 aa, Artificial Sequence
  Synthetic peptide 242-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXEXXXEXXXEX

SEQ ID NO: 255 - protein, 16 aa, Artificial Sequence
  Synthetic peptide 243-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXEXEX

SEQ ID NO: 256 - protein, 16 aa, Artificial Sequence
  Synthetic peptide 244-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXEXKXKXXXEX

SEQ ID NO: 257 - protein, 16 aa, Artificial Sequence
  Synthetic peptide 245-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXEXKXKXEXXX

SEQ ID NO: 258 - protein, 16 aa, Artificial Sequence
  Synthetic peptide 246-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXEXXXKXKXXXEX

SEQ ID NO: 259 - protein, 16 aa, Artificial Sequence
  Synthetic peptide 247-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXEXXXKXKXEXXX

SEQ ID NO: 260 - protein, 16 aa, Artificial Sequence
  Synthetic peptide 248-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXEXEXKXKXXXXX

SEQ ID NO: 261 - protein, 16 aa, Artificial Sequence
  Synthetic peptide 249-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXXXEX

SEQ ID NO: 262 - protein, 16 aa, Artificial Sequence
  Synthetic peptide 250-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXKXKXEXXX

SEQ ID NO: 263 - protein, 16 aa, Artificial Sequence
  Synthetic peptide 251-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXEXKXKXXXXX

SEQ ID NO: 264 - protein, 16 aa, Artificial Sequence
  Synthetic peptide 252-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXEXXXKXKXXXXX

SEQ ID NO: 265 - protein, 16 aa, Artificial Sequence
  Synthetic peptide 253-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXKXKXEXEX

SEQ ID NO: 266 - protein, 16 aa, Artificial Sequence
  Synthetic peptide 254-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXEXEXXXKXEXEX

SEQ ID NO: 267 - protein, 16 aa, Artificial Sequence
  Synthetic peptide 255-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXEXEXKXXXEXEX

SEQ ID NO: 268 - protein, 16 aa, Artificial Sequence
  Synthetic peptide 256-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXEXEXXXKXEXEX

SEQ ID NO: 269 - protein, 16 aa, Artificial Sequence
  Synthetic peptide 257-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXEXEXKXXXEXEX

SEQ ID NO: 270 - protein, 16 aa, Artificial Sequence
  Synthetic peptide 258-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXEXEXXXXXEXEX

SEQ ID NO: 271 - protein, 16 aa, Artificial Sequence
  Synthetic peptide 259-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXXXKXEXEX

SEQ ID NO: 272 - protein, 16 aa, Artificial Sequence
  Synthetic peptide 260-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXKXXXEXEX

SEQ ID NO: 273 - protein, 16 aa, Artificial Sequence
  Synthetic peptide 261-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXEXEXXXXXEXEX

SEQ ID NO: 274 - protein, 16 aa, Artificial Sequence
  Synthetic peptide 262-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXEXEXXXXXEXEX

SEQ ID NO: 275 - protein, 12 aa, Artificial Sequence
  Synthetic peptide 263-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXXXXXEX

SEQ ID NO: 276 - protein, 12 aa, Artificial Sequence
  Synthetic peptide 264-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXXXEXXX

SEQ ID NO: 277 - protein, 12 aa, Artificial Sequence
  Synthetic peptide 265-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXKXKXEXXXXX

SEQ ID NO: 278 - protein, 12 aa, Artificial Sequence
  Synthetic peptide 266-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXKXEXEXEX

SEQ ID NO: 279 - protein, 12 aa, Artificial Sequence
  Synthetic peptide 267-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXKXXXEXEXEX

SEQ ID NO: 280 - protein, 12 aa, Artificial Sequence
  Synthetic peptide 268-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
KXXXXXEXEXEX

SEQ ID NO: 281 - protein, 16 aa, Artificial Sequence
  Synthetic peptide 269-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXEXEX

SEQ ID NO: 282 - protein, 16 aa, Artificial Sequence
  Synthetic peptide 270-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXEXXXEX

SEQ ID NO: 283 - protein, 16 aa, Artificial Sequence
  Synthetic peptide 271-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXEXEXXX

SEQ ID NO: 284 - protein, 16 aa, Artificial Sequence
  Synthetic peptide 272-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXEXXXXXEX

SEQ ID NO: 285 - protein, 16 aa, Artificial Sequence
  Synthetic peptide 273-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXEXXXEXXX

SEQ ID NO: 286 - protein, 16 aa, Artificial Sequence
  Synthetic peptide 274-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXEXEXXXXX

SEQ ID NO: 287 - protein, 16 aa, Artificial Sequence
  Synthetic peptide 275-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXXXEX

SEQ ID NO: 288 - protein, 16 aa, Artificial Sequence
  Synthetic peptide 276-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXXXEXXX

SEQ ID NO: 289 - protein, 16 aa, Artificial Sequence
  Synthetic peptide 277-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXXXEXXXXX

SEQ ID NO: 290 - protein, 16 aa, Artificial Sequence
  Synthetic peptide 278-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXKXKXEXXXXXXX

SEQ ID NO: 291 - protein, 16 aa, Artificial Sequence
  Synthetic peptide 279-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXKXKXEXEXEXEX

SEQ ID NO: 292 - protein, 16 aa, Artificial Sequence
  Synthetic peptide 280-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXXXKXEXEXEXEX

SEQ ID NO: 293 - protein, 16 aa, Artificial Sequence
  Synthetic peptide 281-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXKXXXEXEXEXEX

SEQ ID NO: 294 - protein, 16 aa, Artificial Sequence
  Synthetic peptide 282-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXXXKXEXEXEXEX

SEQ ID NO: 295 - protein, 16 aa, Artificial Sequence
  Synthetic peptide 283-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXKXXXEXEXEXEX

SEQ ID NO: 296 - protein, 16 aa, Artificial Sequence
  Synthetic peptide 284-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXKXXXXXEXEXEXEX

SEQ ID NO: 297 - protein, 16 aa, Artificial Sequence
  Synthetic peptide 285-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXKXEXEXEXEX

SEQ ID NO: 298 - protein, 16 aa, Artificial Sequence
  Synthetic peptide 286-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXKXXXEXEXEXEX

SEQ ID NO: 299 - protein, 16 aa, Artificial Sequence
  Synthetic peptide 287-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXKXXXXXEXEXEXEX

SEQ ID NO: 300 - protein, 16 aa, Artificial Sequence
  Synthetic peptide 288-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
KXXXXXXXEXEXEXEX

SEQ ID NO: 301 - protein, 16 aa, Artificial Sequence
  Synthetic peptide 289-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXDXHXDX

SEQ ID NO: 302 - protein, 16 aa, Artificial Sequence
  Synthetic peptide 290-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXDXHXXXHXDX

SEQ ID NO: 303 - protein, 16 aa, Artificial Sequence
  Synthetic peptide 291-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXDXHXDXHXXX

SEQ ID NO: 304 - protein, 16 aa, Artificial Sequence
  Synthetic peptide 292-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXHXXXHXXXHXDX

SEQ ID NO: 305 - protein, 16 aa, Artificial Sequence
  Synthetic peptide 293-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXHXXXHXDXHXXX

SEQ ID NO: 306 - protein, 16 aa, Artificial Sequence
  Synthetic peptide 294-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXHXDXHXXXHXXX

SEQ ID NO: 307 - protein, 16 aa, Artificial Sequence
  Synthetic peptide 295-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXXXHXDX

SEQ ID NO: 308 - protein, 16 aa, Artificial Sequence
  Synthetic peptide 296-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXDXHXXX

SEQ ID NO: 309 - protein, 16 aa, Artificial Sequence
  Synthetic peptide 297-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXDXHXXXHXXX

SEQ ID NO: 310 - protein, 16 aa, Artificial Sequence
  Synthetic peptide 298-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXHXXXHXXXHXXX

SEQ ID NO: 311 - protein, 12 aa, Artificial Sequence
  Synthetic peptide 299-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXHXXXHXDX

SEQ ID NO: 312 - protein, 12 aa, Artificial Sequence
  Synthetic peptide 300-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXHXDXHXXX

SEQ ID NO: 313 - protein, 12 aa, Artificial Sequence
  Synthetic peptide 301-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXDXHXXXHXXX

SEQ ID NO: 314 - protein, 16 aa, Artificial Sequence
  Synthetic peptide 302-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXHXDXHXDX

SEQ ID NO: 315 - protein, 16 aa, Artificial Sequence
  Synthetic peptide 303-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXHXDXXXDXHXDX

SEQ ID NO: 316 - protein, 16 aa, Artificial Sequence
  Synthetic peptide 304-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXHXDXHXDXXXDX

SEQ ID NO: 317 - protein, 16 aa, Artificial Sequence
  Synthetic peptide 305-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXXXDXXXDXHXDX

SEQ ID NO: 318 - protein, 16 aa, Artificial Sequence
  Synthetic peptide 306-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXXXDXHXDXXXDX

SEQ ID NO: 319 - protein, 16 aa, Artificial Sequence
  Synthetic peptide 307-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXHXDXXXDXXXDX

SEQ ID NO: 320 - protein, 16 aa, Artificial Sequence
  Synthetic peptide 308-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXXXDXHXDX

SEQ ID NO: 321 - protein, 16 aa, Artificial Sequence
  Synthetic peptide 309-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXXXDXHXDXXXDX

SEQ ID NO: 322 - protein, 16 aa, Artificial Sequence
  Synthetic peptide 310-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXDXHXDXXXDXXXDX

SEQ ID NO: 323 - protein, 16 aa, Artificial Sequence
  Synthetic peptide 311-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXDXXXDXXXDXXXDX

SEQ ID NO: 324 - protein, 12 aa, Artificial Sequence
  Synthetic peptide 312-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXXXDXHXDX

SEQ ID NO: 325 - protein, 12 aa, Artificial Sequence
  Synthetic peptide 313-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXDXHXDXXXDX

SEQ ID NO: 326 - protein, 12 aa, Artificial Sequence
  Synthetic peptide 314-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXDXXXDXXXDX

SEQ ID NO: 327 - protein, 16 aa, Artificial Sequence
  Synthetic peptide 315-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXDXDX

SEQ ID NO: 328 - protein, 16 aa, Artificial Sequence
  Synthetic peptide 316-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXDXHXHXXXDX

SEQ ID NO: 329 - protein, 16 aa, Artificial Sequence
  Synthetic peptide 317-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXDXHXHXDXXX

SEQ ID NO: 330 - protein, 16 aa, Artificial Sequence
  Synthetic peptide 318-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXDXXXHXHXXXDX

SEQ ID NO: 331 - protein, 16 aa, Artificial Sequence
  Synthetic peptide 319-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXDXXXHXHXDXXX

SEQ ID NO: 332 - protein, 16 aa, Artificial Sequence
  Synthetic peptide 320-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXDXDXHXHXXXXX

SEQ ID NO: 333 - protein, 16 aa, Artificial Sequence
  Synthetic peptide 321-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXXXDX

SEQ ID NO: 334 - protein, 16 aa, Artificial Sequence
  Synthetic peptide 322-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXDXXX

SEQ ID NO: 335 - protein, 16 aa, Artificial Sequence
  Synthetic peptide 323-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXDXHXHXXXXX

SEQ ID NO: 336 - protein, 16 aa, Artificial Sequence
  Synthetic peptide 324-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXDXXXHXHXXXXX

SEQ ID NO: 337 - protein, 16 aa, Artificial Sequence
  Synthetic peptide 325-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXHXHXDXDX

SEQ ID NO: 338 - protein, 16 aa, Artificial Sequence
  Synthetic peptide 326-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXDXDXXXHXDXDX

SEQ ID NO: 339 - protein, 16 aa, Artificial Sequence
  Synthetic peptide 327-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXDXDXHXXXDXDX

SEQ ID NO: 340 - protein, 16 aa, Artificial Sequence
  Synthetic peptide 328-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXDXDXXXHXDXDX

SEQ ID NO: 341 - protein, 16 aa, Artificial Sequence
  Synthetic peptide 329-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXDXDXHXXXDXDX

SEQ ID NO: 342 - protein, 16 aa, Artificial Sequence
  Synthetic peptide 330-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXDXDXXXXXDXDX

SEQ ID NO: 343 - protein, 16 aa, Artificial Sequence
  Synthetic peptide 331-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXXXHXDXDX

SEQ ID NO: 344 - protein, 16 aa, Artificial Sequence
  Synthetic peptide 332-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXDXDXHXXXDXDX

SEQ ID NO: 345 - protein, 16 aa, Artificial Sequence
  Synthetic peptide 333-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXDXDXXXXXDXDX

SEQ ID NO: 346 - protein, 16 aa, Artificial Sequence
  Synthetic peptide 334-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXDXDXXXXXDXDX

SEQ ID NO: 347 - protein, 12 aa, Artificial Sequence
  Synthetic peptide 335-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXXXXXDX

SEQ ID NO: 348 - protein, 12 aa, Artificial Sequence
  Synthetic peptide 336-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXXXDXXX

SEQ ID NO: 349 - protein, 12 aa, Artificial Sequence
  Synthetic peptide 337-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXDXXXXX

SEQ ID NO: 350 - protein, 12 aa, Artificial Sequence
  Synthetic peptide 338-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXHXDXDXDX

SEQ ID NO: 351 - protein, 12 aa, Artificial Sequence
  Synthetic peptide 339-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXHXXXDXDXDX

SEQ ID NO: 352 - protein, 12 aa, Artificial Sequence
  Synthetic peptide 340-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXXXDXDXDX

SEQ ID NO: 353 - protein, 16 aa, Artificial Sequence
  Synthetic peptide 341-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXDXDX

SEQ ID NO: 354 - protein, 16 aa, Artificial Sequence
  Synthetic peptide 342-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXDXXXDX

SEQ ID NO: 355 - protein, 16 aa, Artificial Sequence
  Synthetic peptide 343-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXDXDXXX

SEQ ID NO: 356 - protein, 16 aa, Artificial Sequence
  Synthetic peptide 344-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXDXXXXXDX

SEQ ID NO: 357 - protein, 16 aa, Artificial Sequence
  Synthetic peptide 345-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXDXXXDXXX

SEQ ID NO: 358 - protein, 16 aa, Artificial Sequence
  Synthetic peptide 346-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXDXDXXXXX

SEQ ID NO: 359 - protein, 16 aa, Artificial Sequence
  Synthetic peptide 347-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXXXDX

SEQ ID NO: 360 - protein, 16 aa, Artificial Sequence
  Synthetic peptide 348-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXDXXX

SEQ ID NO: 361 - protein, 16 aa, Artificial Sequence
  Synthetic peptide 349-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXDXXXXX

SEQ ID NO: 362 - protein, 16 aa, Artificial Sequence
  Synthetic peptide 350-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXDXXXXXXX

SEQ ID NO: 363 - protein, 16 aa, Artificial Sequence
  Synthetic peptide 351-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXHXHXDXDXDXDX

SEQ ID NO: 364 - protein, 16 aa, Artificial Sequence
  Synthetic peptide 352-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXXXHXDXDXDXDX

SEQ ID NO: 365 - protein, 16 aa, Artificial Sequence
  Synthetic peptide 353-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXHXXXDXDXDXDX

SEQ ID NO: 366 - protein, 16 aa, Artificial Sequence
  Synthetic peptide 354-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXXXHXDXDXDXDX

SEQ ID NO: 367 - protein, 16 aa, Artificial Sequence
  Synthetic peptide 355-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXDXDXDXDX

SEQ ID NO: 368 - protein, 16 aa, Artificial Sequence
  Synthetic peptide 356-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXDXDXDXDX

SEQ ID NO: 369 - protein, 16 aa, Artificial Sequence
  Synthetic peptide 357-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXHXDXDXDXDX

SEQ ID NO: 370 - protein, 16 aa, Artificial Sequence
  Synthetic peptide 358-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXHXXXDXDXDXDX

SEQ ID NO: 371 - protein, 16 aa, Artificial Sequence
  Synthetic peptide 359-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXXXXXDXDXDXDX

SEQ ID NO: 372 - protein, 16 aa, Artificial Sequence
  Synthetic peptide 360-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXXXXXDXDXDXDX

SEQ ID NO: 373 - protein, 16 aa, Artificial Sequence
  Synthetic peptide 361-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXEXHXEX

SEQ ID NO: 374 - protein, 16 aa, Artificial Sequence
  Synthetic peptide 362-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXEXHXXXHXEX

SEQ ID NO: 375 - protein, 16 aa, Artificial Sequence
  Synthetic peptide 363-XZ
  misc_feature (3)..(3): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXEXHXEXHXXX

SEQ ID NO: 376 - protein, 16 aa, Artificial Sequence
  Synthetic peptide 364-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXHXXXHXXXHXEX

SEQ ID NO: 377 - protein, 16 aa, Artificial Sequence
  Synthetic peptide 365-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXHXXXHXEXHXXX

SEQ ID NO: 378 - protein, 16 aa, Artificial Sequence
  Synthetic peptide 366-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXHXEXHXXXHXXX

SEQ ID NO: 379 - protein, 16 aa, Artificial Sequence
  Synthetic peptide 367-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXXXHXEX

SEQ ID NO: 380 - protein, 16 aa, Artificial Sequence
  Synthetic peptide 368-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXHXEXHXXX

SEQ ID NO: 381 - protein, 16 aa, Artificial Sequence
  Synthetic peptide 369-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXEXHXXXHXXX

SEQ ID NO: 382 - protein, 16 aa, Artificial Sequence
  Synthetic peptide 370-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXHXXXHXXXHXXX

SEQ ID NO: 383 - protein, 12 aa, Artificial Sequence
  Synthetic peptide 371-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXHXXXHXEX

SEQ ID NO: 384 - protein, 12 aa, Artificial Sequence
  Synthetic peptide 372-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXHXEXHXXX

SEQ ID NO: 385 - protein, 12 aa, Artificial Sequence
  Synthetic peptide 373-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXEXHXXXHXXX

SEQ ID NO: 386 - protein, 16 aa, Artificial Sequence
  Synthetic peptide 374-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXHXEXHXEX

SEQ ID NO: 387 - protein, 16 aa, Artificial Sequence
  Synthetic peptide 375-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXHXEXXXEXHXEX

SEQ ID NO: 388 - protein, 16 aa, Artificial Sequence
  Synthetic peptide 376-XZ
  misc_feature (1)..(1): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXHXEXHXEXXXEX

SEQ ID NO: 389 - protein, 16 aa, Artificial Sequence
  Synthetic peptide 377-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXXXEXXXEXHXEX

SEQ ID NO: 390 - protein, 16 aa, Artificial Sequence
  Synthetic peptide 378-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXXXEXHXEXXXEX

SEQ ID NO: 391 - protein, 16 aa, Artificial Sequence
  Synthetic peptide 379-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXHXEXXXEXXXEX

SEQ ID NO: 392 - protein, 16 aa, Artificial Sequence
  Synthetic peptide 380-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXXXEXHXEX

SEQ ID NO: 393 - protein, 16 aa, Artificial Sequence
  Synthetic peptide 381-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXXXEXHXEXXXEX

SEQ ID NO: 394 - protein, 16 aa, Artificial Sequence
  Synthetic peptide 382-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXEXHXEXXXEXXXEX

SEQ ID NO: 395 - protein, 16 aa, Artificial Sequence
  Synthetic peptide 383-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXEXXXEXXXEXXXEX

SEQ ID NO: 396 - protein, 12 aa, Artificial Sequence
  Synthetic peptide 384-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXXXEXHXEX

SEQ ID NO: 397 - protein, 12 aa, Artificial Sequence
  Synthetic peptide 385-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXEXHXEXXXEX

SEQ ID NO: 398 - protein, 12 aa, Artificial Sequence
  Synthetic peptide 386-XZ
  misc_feature (5)..(5): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXEXXXEXXXEX

SEQ ID NO: 399 - protein, 16 aa, Artificial Sequence
  Synthetic peptide 387-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXEXEX

SEQ ID NO: 400 - protein, 16 aa, Artificial Sequence
  Synthetic peptide 388-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXEXHXHXXXEX

SEQ ID NO: 401 - protein, 16 aa, Artificial Sequence
  Synthetic peptide 389-XZ
  misc_feature (5)..(5): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXEXHXHXEXXX

SEQ ID NO: 402 - protein, 16 aa, Artificial Sequence
  Synthetic peptide 390-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXEXXXHXHXXXEX

SEQ ID NO: 403 - protein, 16 aa, Artificial Sequence
  Synthetic peptide 391-XZ
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXEXXXHXHXEXXX

SEQ ID NO: 404 - protein, 16 aa, Artificial Sequence
  Synthetic peptide 392-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXEXEXHXHXXXXX

SEQ ID NO: 405 - protein, 16 aa, Artificial Sequence
  Synthetic peptide 393-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXXXEX

SEQ ID NO: 406 - protein, 16 aa, Artificial Sequence
  Synthetic peptide 394-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXHXHXEXXX

SEQ ID NO: 407 - protein, 16 aa, Artificial Sequence
  Synthetic peptide 395-XZ
  misc_feature (5)..(5): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXEXHXHXXXXX

SEQ ID NO: 408 - protein, 16 aa, Artificial Sequence
  Synthetic peptide 396-XZ
  misc_feature (7)..(7): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXEXXXHXHXXXXX

SEQ ID NO: 409 - protein, 16 aa, Artificial Sequence
  Synthetic peptide 397-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXHXHXEXEX

SEQ ID NO: 410 - protein, 16 aa, Artificial Sequence
  Synthetic peptide 398-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXEXEXXXHXEXEX

SEQ ID NO: 411 - protein, 16 aa, Artificial Sequence
  Synthetic peptide 399-XZ
  misc_feature (1)..(1): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXEXEXHXXXEXEX

SEQ ID NO: 412 - protein, 16 aa, Artificial Sequence
  Synthetic peptide 400-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXEXEXXXHXEXEX

SEQ ID NO: 413 - protein, 16 aa, Artificial Sequence
  Synthetic peptide 401-XZ
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXEXEXHXXXEXEX

SEQ ID NO: 414 - protein, 16 aa, Artificial Sequence
  Synthetic peptide 402-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXEXEXXXXXEXEX

SEQ ID NO: 415 - protein, 16 aa, Artificial Sequence
  Synthetic peptide 403-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXXXHXEXEX

SEQ ID NO: 416 - protein, 16 aa, Artificial Sequence
  Synthetic peptide 404-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXEXEXHXXXEXEX

SEQ ID NO: 417 - protein, 16 aa, Artificial Sequence
  Synthetic peptide 405-XZ
  misc_feature (1)..(1): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXEXEXXXXXEXEX

SEQ ID NO: 418 - protein, 16 aa, Artificial Sequence
  Synthetic peptide 406-XZ
  misc_feature (3)..(3): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXEXEXXXXXEXEX

SEQ ID NO: 419 - protein, 12 aa, Artificial Sequence
  Synthetic peptide 407-XZ
  misc_feature (7)..(7): Xaa can be Ala, Val, Leu, Ile, Met, Phe, Trp, Gly, Tyr, Ser, Thr, Asn, Gln, or Cys
  misc_feature (9)..(9): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXXXXXEX

SEQ ID NO: 420 - protein, 12 aa, Artificial Sequence
  Synthetic peptide 408-XZ
  misc_feature (7)..(7): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXXXEXXX

SEQ ID NO: 421 - protein, 12 aa, Artificial Sequence
  Synthetic peptide 409-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXHXHXEXXXXX

SEQ ID NO: 422 - protein, 12 aa, Artificial Sequence
  Synthetic peptide 410-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXXXHXEXEXEX

SEQ ID NO: 423 - protein, 12 aa, Artificial Sequence
  Synthetic peptide 411-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
XXHXXXEXEXEX

SEQ ID NO: 424 - protein, 12 aa, Artificial Sequence
  Synthetic peptide 412-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
HXXXXXEXEXEX

SEQ ID NO: 425 - protein, 16 aa, Artificial Sequence
  Synthetic peptide 413-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXEXEX

SEQ ID NO: 426 - protein, 16 aa, Artificial Sequence
  Synthetic peptide 414-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXEXXXEX

SEQ ID NO: 427 - protein, 16 aa, Artificial Sequence
  Synthetic peptide 415-XZ
  misc_feature (9)..(9): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXEXEXXX

SEQ ID NO: 428 - protein, 16 aa, Artificial Sequence
  Synthetic peptide 416-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXEXXXXXEX

SEQ ID NO: 429 - protein, 16 aa, Artificial Sequence
  Synthetic peptide 417-XZ
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXEXXXEXXX

SEQ ID NO: 430 - protein, 16 aa, Artificial Sequence
  Synthetic peptide 418-XZ
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXEXEXXXXX

SEQ ID NO: 431 - protein, 16 aa, Artificial Sequence
  Synthetic peptide 419-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXXXEX

SEQ ID NO: 432 - protein, 16 aa, Artificial Sequence
  Synthetic peptide 420-XZ
  misc_feature (9)..(9): Xaa can be Ala, Val, Leu, Ile, Met, Phe, Trp, Gly, Tyr, Ser, Thr, Asn, Gln, or Cys
  misc_feature (11)..(11): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXXXEXXX

SEQ ID NO: 433 - protein, 16 aa, Artificial Sequence
  Synthetic peptide 421-XZ
  misc_feature (9)..(9): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXXXEXXXXX

SEQ ID NO: 434 - protein, 16 aa, Artificial Sequence
  Synthetic peptide 422-XZ
  misc_feature (11)..(11): Xaa can be Ala, Val, Leu, Ile, Met, Phe, Trp, Gly, Tyr, Ser, Thr, Asn, Gln, or Cys
  misc_feature (13)..(13): Xaa can be Ala, Val, Leu, Ile, Met, Phe, Trp, Gly, Tyr, Ser, Thr, Asn, Gln, or Cys
  misc_feature (15)..(15): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXHXHXEXXXXXXX

SEQ ID NO: 435 - protein, 16 aa, Artificial Sequence
  Synthetic peptide 423-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXHXHXEXEXEXEX

SEQ ID NO: 436 - protein, 16 aa, Artificial Sequence
  Synthetic peptide 424-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXXXHXEXEXEXEX

SEQ ID NO: 437 - protein, 16 aa, Artificial Sequence
  Synthetic peptide 425-XZ
  misc_feature (1)..(1): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXHXXXEXEXEXEX

SEQ ID NO: 438 - protein, 16 aa, Artificial Sequence
  Synthetic peptide 426-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXXXHXEXEXEXEX

SEQ ID NO: 439 - protein, 16 aa, Artificial Sequence
  Synthetic peptide 427-XZ
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXHXXXEXEXEXEX

SEQ ID NO: 440 - protein, 16 aa, Artificial Sequence
  Synthetic peptide 428-XZ
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXHXXXXXEXEXEXEX

SEQ ID NO: 441 - protein, 16 aa, Artificial Sequence
  Synthetic peptide 429-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXXXHXEXEXEXEX

SEQ ID NO: 442 - protein, 16 aa, Artificial Sequence
  Synthetic peptide 430-XZ
  misc_feature (1)..(1): Xaa can be Ala, Val, Leu, Ile, Met, Phe, Trp, Gly, Tyr, Ser, Thr, Asn, Gln, or Cys
  misc_feature (3)..(3): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXXXHXXXEXEXEXEX

SEQ ID NO: 443 - protein, 16 aa, Artificial Sequence
  Synthetic peptide 431-XZ
  misc_feature (1)..(1): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
XXHXXXXXEXEXEXEX

SEQ ID NO: 444 - protein, 16 aa, Artificial Sequence
  Synthetic peptide 432-XZ
  misc_feature (3)..(3): Xaa can be Ala, Val, Leu, Ile, Met, Phe, Trp, Gly, Tyr, Ser, Thr, Asn, Gln, or Cys
  misc_feature (5)..(5): Xaa can be Ala, Val, Leu, Ile, Met, Phe, Trp, Gly, Tyr, Ser, Thr, Asn, Gln, or Cys
  misc_feature (7)..(7): Xaa can be Ala, Val, Leu, Ile, Met, Phe, Trp, Gly, Tyr, Ser, Thr, Asn, Gln, or Cys
  misc_feature (2)..(2): Xaa can be Ala, Val, Leu, Ile, Met, Phe, Trp, or Gly
  misc_feature (4)..(4): Xaa can be Ala, Val, Leu, Ile, Met, Phe, Trp, or Gly
  misc_feature (6)..(6): Xaa can be Ala, Val, Leu, Ile, Met, Phe, Trp, or Gly
  misc_feature (8)..(8): Xaa can be Ala, Val, Leu, Ile, Met, Phe, Trp, or Gly
  misc_feature (10)..(10): Xaa can be Ala, Val, Leu, Ile, Met, Phe, Trp, or Gly
  misc_feature (12)..(12): Xaa can be Ala, Val, Leu, Ile, Met, Phe, Trp, or Gly
  misc_feature (14)..(14): Xaa can be Ala, Val, Leu, Ile, Met, Phe, Trp, or Gly
  misc_feature (16)..(16): Xaa can be Ala, Val, Leu, Ile, Met, Phe, Trp, or Gly
HXXXXXXXEXEXEXEX

The invention claimed is:

1. A self-assembling peptide comprising polar amino acid residues and nonpolar amino acid residues,
wherein the self-assembling peptide consists of 12 to 32 amino acid residues, comprises one or more acidic amino acid residues and one or more basic amino acid residues as the polar amino acid residues,
wherein the sum of charge of the acidic amino acid residue(s) and charge of the basic amino acid residue(s), when the self-assembling peptide is in a neutral pH environment, is from −3 to −2 or +2 to +3, wherein all of the amino acids in the self-assembling peptide form a beta (β)-sheet structure in which one face consists of only nonpolar amino acid residues upon self-assembly in a neutral aqueous solution, and wherein the nonpolar amino acid residues are selected from the group consisting of alanine, glycine, leucine, isoleucine, methionine, valine, phenylalanine, and tryptophan.

2. The self-assembling peptide according to claim 1, wherein the peptide forms a (β)-sheet structure in which one face consists of only nonpolar amino acid residues, and the polar amino acid residues and the nonpolar amino acid residues are arranged on the other face, upon self-assembly in a neutral aqueous solution.

3. The self-assembling peptide according to claim 2, further comprising at least one neutral amino acid residue as a polar amino acid residue.

4. The self-assembling peptide according to claim 3, wherein the neutral amino acid residue is an amino acid residue selected from the group consisting of asparagine, glutamine, serine, threonine, tyrosine, and cysteine.

5. The self-assembling peptide according to claim 1, wherein the one or more acidic amino acid residues are selected from the group consisting of aspartic acid and/or glutamic acid.

6. The self-assembling peptide according to claim 1, wherein the one or more basic amino acid residues are selected from the group consisting of arginine, histidine, lysine and ornithine.

7. The self-assembling peptide according to claim 1, wherein the self-assembling peptide consists of 12 to 16 amino acid residues.

8. The self-assembling peptide according to claim 1, wherein the peptide is capable of forming a gel in a pH of from 6 to 8.

* * * * *